United States Patent 7,635,798 (NUCLEIC ACID COMPOSITIONS CONFERRING ALTERED METABOLIC CHARACTERISTICS) - sequence listing, part 3

SEQ ID NO: 5662 - DNA, 577 bp, Artificial
  Synthetic
tcacagtagtgagtgcatgcagtacttgcccaggccctaaacctaaacctaaaccaaagccaaagccaaagccatgcccccctcctccttcttctcatggtggcaaatgcccaactgatgccttaaaactaggcgtttgcgctaatgtgcttaacggtttgctgaatgttaccctgggaactcctccagtaaaaccatgctgcagtcttattggaaatcttgtggatttggaggctgctgtctgcctttgcactgcccttaaggctaacattttgggcatcaaccttaatctccctatttctcttaacttactgctcaatgtttgtagtaagaaggctccaaagggattcacttgtccctaaatggttctctcgcttttcgtttttcttctgaagttggtttttgattttcatttgtttagcagtttgtgatgttcgatttatctcctgcattaaacttcttgttaggtgcaaggttgtggtttgttttggattgatcattgttggaaagcgcttttgtaaggccaattgtttgtgtaccctttggaaataaatatatttcttggatgattctctct

SEQ ID NO: 5663 - DNA, 788 bp, Artificial
  Synthetic
cccacgcgtccgcccacgcgtccgcccacgcgtccgcaaaaagcagctccagcttcttctgatcgatcgatcgagctgagctataggcagtagctgctaattaagctaattaattgctaagcagtagtagagctagctaattaattaagatggccggcaagaaggtgcaggtttgtgcgctgttccttgccctcaatgtgctcttcaccatgcagatgggtgcagtagtgcaggcatgcgagccctactgccccacaccgacgccgccggtgacgccgcctccgtcgccgccgtcgggtggagggaataagtgcccgatcgacgcgctgaagctgagcgtgtgcgccaacgtgctcaacctgctgaagctgaagatcggcgtgccggagagcgagcagtgctgcccgttgctgggtggcctcgtcgacctcgacgccgccgtctgcctctgcaccgccatcaaggccaacatcctcggcatcaatctcaacatccccgtcgatctctctctccttctcaactactgccacaagacctgcccctccgacttcacctgccctctctaaattaatcgatcctccgatcccttaattaccataccattacaccatgcatcaatatccatatatatataaaccctttcgcacgtacttatactatgttttgtcatacatatatatgtgtcgaacgatcgatctatcactgatatgatatgattgatccatcagcctgatctctgtatcttgttatttgtataccgtcaaataaaagtttcttccacttgtgtt

SEQ ID NO: 5664 - DNA, 635 bp, Artificial
  Synthetic
  misc_feature (244)..(244): The residue at this position can be any nucleotide.
  misc_feature (246)..(247): The residues at these positions can be any nucleotide.
  misc_feature (290)..(290): The residue at this position can be any nucleotide.
catctccagaagatcaagagctcttaattagctagctagtgattagctgcgcttgtgatcgatcgatctcgggtacgtagcaatggcgtccaaggcgtcgctctgttcctggccgtgaacctcgtcgtgctcggggtggcaagcgcctgcggcggcagcccgtcgtgcccgacgccgacgccgtcgaccccgacattgtcaacgccgacgccgacgccgtcggcgttcgggagggggtggcccncnncgcgacgcgctgaagctgggcgtgtgcgccaacgtgctgggcnctgatcaaggccaaggtgggcgtgcctccggcggagccgtgctgcccgctgctggaggggctcgtcgacctcgaggcggcggtgtgcctctgcacggccatcaggggcaacatcctcggaatcaacctcaacctccccatcgacctcagcctcatcctcaactactgcggcaagaccgtccccaccggcttcaagtgctaagcagcgtgcatatgcaatgcctgcatgggttgatcctacgtacggtgattagttggctttgacgactcttgatttgatttgcttgctgctctgtttatttgctactacgttacgtacgtactttgcatgcaacgcaacgcatga

SEQ ID NO: 5665 - DNA, 567 bp, Artificial
  Synthetic
cccccgaactaagctactactcgaagaagaggaagaccgccatgactacttccacccttctcttcctcctcctcgccggcctcaccgccgccgccctcggcacggcggacgacgacaccaccaccaacaccatacgcctcccgaccgacggaggatcagcacagcaggcgccgacgaagaagaagccgtggaagtgctgcgacaacatcgagcggctgccgacgaagaccaacccgccgcagtggcgctgcaacgacgagctggagcccagcaagtgcgtggcacagtgcgaggtgtgccaggaggcgccggggccattcccgggcccgctcatctgcagcgacgtctactggggcgccgacccgggtcccttctgcacgccgcggccgtggggagattgctgcaccaacaccacctgcaccaggtcgatcccgccgatctgccgctgcaacgacaaggtgaagaagtgcgccgccgcgtgcaaggattgcaagcgggtgaagtcgtcgaagcctcctcgctacgtctagccagtgaccaagagcaaaataaatgaataaatgttgc

SEQ ID NO: 5666 - DNA, 611 bp, Artificial
  Synthetic
ccgagcacaacaccacaaaccaagatgagtaacaacagcatggctacttccaccatcctgctcttcctcctcgccgtcggcggcctcgccgccgcccacggcgacaccatccgtctccccagcgaaggcgacgcaccaccgcagcccgccaaaccctgggactgctgcgacgatatcgagatgtccccgctaaagatcttcccgccgctttaccgctgcaacgacgaggtcaagcagtgctcggccgcctgcaaggagtgcgtggcggcgccggcggccggagactccccctgcggcggcggcgccgccctcgtctgccgcgactggtactcgacggaggaccccggcaagccgtgcacgccggagcgggaatggccggagcggacgacgaagaagaggccgtggaagtgctgcgacaacatccggcggctgccgccgaggatccacccgccgttctggcgctgcgacgacgagctcaagcccggccagtgcttcgccgcgtgcaaggcttgccgggaggcgccggggccattcccggggccgctcatctgcgacgacgtctactggggcgccgacccgggtcccttctgcacgccggggccgtgggggga

SEQ ID NO: 5667 - DNA, 621 bp, Artificial
  Synthetic
caaagatgagcaacaccaccatgggtatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcgacttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggccccttgtgcacgccgcggccatgggggaaatgctgcgacaaggccttctgcaacaagatgaacccgccgacctgccgct

SEQ ID NO: 5668 - DNA, 635 bp, Artificial
  Synthetic
cccacgcgtccgcccacgcgtccgagatgaagcgcaccatggctgctacttccatcctgttcttcttcctcgccggcctcgccgccgcccacggcagcacagcggacgacaccacgaccaccaccaccaacaccatacgcctcccgatcgacggagcagtggcggcgcgaaggaggacgaggccgtggaagtgctgcgacaacatcgtgaggctgccggagaggatcaacccgccgttctggcagtgcgacgacgagctggagcccgggcagtgcttccgccagtgcgaggcgtgccgggatccgccggggcggccgttccccggccggccgctcatctgcgacgacgtcttctggggcgacgacccgggcacctcgtgcgcgccgtcgtcggagtggccgtggggcccgtgctgcgacatcgccgtctgcaccaagtcgctccctcccatctgccactgctccgacgaggtggagtcgtgcgccgccgcgtgcgggcagtgcgagatggtggactcgtggtcgtggcgccctctcttcgtctgccgtgactccttcaccggggacccaggccccaggtgcacacctgaaatgcacaactaagaagagaactacttctctgtataacaagcagag

SEQ ID NO: 5669 - DNA, 657 bp, Artificial
  Synthetic
tcttagcaactgctgctcatgatggtgttaaacttgggatttacgcaaatgaagaattccgaaatttctctctttatgatgaaaatacaccgactcaatcagtgcaatttgaccatagtggaagttatctggccttaggaggctcagatatacgagttttccaagtcgccagtgttaaggctgaatggaatcacatcaaaaccctccccttcttatcaggcacaggtaaagcaacatgtctgaaatttggtccagatgcaaaatacatagctgtaggatctatggaccgtaatttaagaatatttgggctgcctggcgaggatcaaatggagagttaggctcatttccagcatgaaagcaaacagtcagcgccacagcttcgaatctgctgagaccactgtattatctctaggggagaggttgatgggtcctgttttattatgtaattcttctggtttttgctagatctttgggtggtctggcaaatagacataccaccaacttgggataatatccgaagtgcagggtttatttggtcgtctcaataccatccttgggcagtctattgtatcattgttgtaaccattgcctatcctgggagcaagtctgaatggaaacgatcagttacaatacattgagatgccaagttagtagctg

SEQ ID NO: 5670 - DNA, 647 bp, Artificial
  Synthetic
cgatattccatcaggatctggcctcacacaggttggcgagtcttcaggacaagagggatatacatctgcatctttccacccagatggtcttatcctggggacagggaccactgaagctgttgtcaaaatttgggatgtgaagacgcagtcaaatgttgcaaagtttgaggggcatgttggaccagtgactgctatgtccttctctgaaaatggttacttccttgcgactgctgctcttgatggagtcaagctttgggatcttcgaaaattaagaaactttaggacgatatcaccttatgactcagacacgccaacaaattctgtggaatttgactttagcggaagttatctagctgttggtggttcagatacaagggtttaccaagtagcaaatgttaagcttgaatggaatcttgtcaagaccttaccagatttgtcaggcacagggaaagtgacaaacgtcaagtttggcaccgatgcgaagtacattgccgtaggttctatggatcgtaacctacggatatttgggcttccgggagaagatgatcaaatggacgacgcaaagccatcggaagagtgatgaaaccaattgtacttcatttggcctgcgtaaattgctccctgtttgtgtgttttgacggtggatg

SEQ ID NO: 5671 - DNA, 271 bp, Artificial; identical to SEQ ID NO: 4209
  Synthetic

SEQ ID NO: 5672 - DNA, 629 bp, Artificial
  Synthetic
acgaccgcctgctagctgagtatctctttcgtccgaccccgaaggtatcccagctatggcgttcgctctcgagaggtctgctctcctcggcaattccgtcgtcggtttgccttccctgcccaagcttagtatagcctcccccccttccaccgtcaaaatctttgccagcggagcaaagaagattaagaccaaggcaccactcggtccttccggagatacctcttaccgtaatggagctgatgcttctggatccaagggcaagggtaagggagtgtaccagtttgtcaacaagtatggagccaatgtcgatggttacagcccaattttcacccctgatgagtggtcacccaatggagatacctacgtcggcggtaccactggattggctatctgggctgtgaccctcggaggccttctcctcgctggtgtcttccttgtttatagtaccagtgccctttcacagtagattgttgttgaaaagacagacaatcctcatttacaatttatcttatgattatatgtaaaccattgaacatacttcgctgctatcaatgaatgagagctatcatctctccatttcattattgtaattgtcggtcattcgaatcggaacatttgatctattttat

SEQ ID NO: 5673 - DNA, 688 bp, Artificial
  Synthetic
aattatattgagctgccattgcttctcacctctgctttgcatccatccatccatcagagatcaggtagaacagtgagagtgaggtgcagaaaaatttgaactgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacgggattggaggtggcatgtcagtcgatattgatgcatctggcaggaagagcacggggaagggtgtgtaccaattcgttgacaagtacggcgcaaacgtcgacggctacagcccaatctactcgccggaggaatggtctcccaccggtgacacctacgttggtggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatactcg

SEQ ID NO: 5674 - DNA, 630 bp, Artificial
  Synthetic
accgcctgctagctgagtatctctttcgtccgaccccgaaggtatcccagctatggcgttcgctctcgagaggtctgctctcctcggcaattccgtcgtcggtttgccttccctgcccaagcttagtatagcctcccccccttccaccgtcaaaatctttgccagcggagcaaagaagattaagaccaaggcaccactcggtccttccggagatacctcttaccgtaatggagctgatgcttctggatccaagggcaagggtaagggagtgtaccagtttgtcaacaagtatggagccaatgtcgatggttacagcccaatcttcacccctgatgagtggtcacccaatggagatacctacgtcggcggtaccactggattggctatctgggctgtgaccctcggaggccttctcctcgctggtgtcttccttgtttatagtaccagtgccctttcacagtagattgttgttgaaaagacagacaatcctcatttacaatttatcttatgattatatgtaaaccattgaacatacttcgctgctatcaatgaatgagagctatcatctctccatttcattattgtaattgtcggtcattcgaatcggaacatttgatctattttagagct

SEQ ID NO: 5675 - DNA, 570 bp, Artificial
  Synthetic
gaaagagagtgagagagctcgagcaatggcggcagtgttggagagctcggccttctgcggctcggccctggcagcagcagcaccagctcggggcctccccgcattgagcagcagcaggctcaccgtgagagccagcggcggcaagaagatctcgacgaaaacacctctaggaccttctggggacctcagttttaagtctggacgcgatgcttctggacgtggcaccacgggaaagggcgtgtatcaattcacaaagaaatacggagctaacgtggatggatacagtccgatctatactccggacgaatggtcgccttcgggagacgtttacacgggtggccagactgggcttttgctatgggcagtaacgctgggaggtatactactggccggtgtgttcctcgtatacagtactagtgctctcgcaagctaaatcgtgtaaacgttatattgtcaaaaagcgagcaaaaaggattatttccatacattgtccatagcttggacacgacttcaatgtagataaaggttgtattaatatttacaaatatatcgtattttcttaccaaaaaa

SEQ ID NO: 5676 - DNA, 529 bp, Artificial
  Synthetic
tcgggtatcaacgcaaagtggccatacggccgggggtgagaagagatcgagagaagaatagtttgatcatcttgtgagaaaaataatggctgcttcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcat

SEQ ID NO: 5677 - DNA, 728 bp, Artificial
  Synthetic
ccccgggccaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacgggattggaggtggcatgtcagtcgatattgatgcatctggcaggaagagcacggggaagggtgtgtaccaattcgttgacaagtacggcgcaaacgtcgacggctacagcccaatctactcgccggaggaatggtctcccaccggtgacacctacgttggtggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggaga

SEQ ID NO: 5678 - DNA, 568 bp, Artificial
  Synthetic
ttagcccccgcccaacccgcccggagacgagacgccaccggagttccccccaccaccgctcgccgccttctccgcctcgcctcgccgccgcgtcgaccgccatggctgagactgttgtgctcagggttgggatgtcctgtgaaggttgtgttggagctgttaagcgggtactgggaaagatgcaaggagtggagtcctttgacgtagacatcaaggagcagaaggtcactgtcaagggaaatgttacaccagatgccgttcttcagaccgtttcaaagacgggcaagaagacctcgttctgggatgctgagcctgcacctgttgaagctactgctgcttcatcttaaaatgtcattttatctcctgtgatatgtaaaggttgatgtaacaatttcccagtggaactgtcttgtgagatcacaaagttgtctgttcttatgatcataacttgaagctatttcaaataatatcagacagctagttacacatatgtacatctttgtatttctctatcctaccagtattggactattggtatgatcaatttggtaaaaatacatggttcatc

SEQ ID NO: 5679 - DNA, 357 bp, Artificial
  Synthetic
  misc_feature (345)..(345): The residue at this position can be any nucleotide.
ggcggatgagactgtggagctcaaggtggccatgacttgcgagggctgcgtcggtgcagtcaagagagttcttggcaaaatgcaaggtgtggagtcgttcgatgtcgatctcaagcagcaaaaggtaaccgtcaaaggcgccgtgaagccggacgatgtgctccaggtggtgtccaagacgggcaaagccaccaccttttggccaaaggaggagtgatcaatccactcgtcaataatcgactaaactgtagtgatcacagcgggatcacatgtacagacaagtccacaatgatacgcacgctatacacttcgatctatatatatacaccttgattttcctagaanaaaaaaaaaaaa

SEQ ID NO: 5680 - DNA, 406 bp, Artificial
  Synthetic
gcaccaccaagctttggatatggccacggagactgtggaactgaaggttgagatgacttgtgaaggctgtgttggagcagtcaaaagagtcttaaacaaaatgcaaggggtggaatcttatgaagtggatttgaaagagaaaaaggtaattgtgaaggggaatgttaagcctgaagatgtcctcaaaacagtttccaaaactggcaaggctactcagtattggccaaaagagtagggaggaagcaaatgtctaaagcatagcctattcttatttataaatagactatatgcctgaactaaatggaaatctcaattaagtctttgaataaattttctgttgttaattataaacatataacctaaaagtttgggattttctttgatttggctaacaaaaaaccacaac

SEQ ID NO: 5681 - DNA, 376 bp, Artificial
  Synthetic
gccattacggccggggataacctcaaaggccaaatagataggttcttcccacgaaagtaaaaatctccctcatttttccccctactacttttcatcatcatgtctcaggtacacattctttttacccttcattttctttttcagatcattttgataatactaattacattcatactaatgttactctatcttttttgctagtaattgtcatctgtcaactgtaataatcttggaaatctctaaagggattgaaattttttggttgtagaaccccaattttaatttggtttttctcattttgagctgaaaattttggttattggtgtgtgaattttttgttacaatgtaaagaagaaacataaagctttgaaatgct

SEQ ID NO: 5682 - DNA, 477 bp, Artificial
  Synthetic
agaagaagcactaagcaagagtccatccatatacaatggctactcagactgtggagctgaaggttaccatgagttgtcaaggatgtgttggggctgttaaaagggtgcttgataagatggaaggagtggaatcgtatgatattgacttgaaggagcaaaaagtagtggtgaagggcaatgcgaaaccagaggatgtgttcaacacggtctccaagacggggaaggccacatcatactggcctacagaacaagtggtagcagcatgatatgtgtgtagacccttttaagaagttgctagattctagtagcttataacctacatggcctaaatgcttctattgtattgataaggtataaataatataattatgcaaatctttgtcaaaataattgtcttacactatgaaaacaatcattctagttttccataattaatttccttactattgaatagcaaaaataaatcaaaaaaccact

SEQ ID NO: 5683 - DNA, 922 bp, Artificial
  Synthetic
tatttttattccgtcagctgtttagcaagagaagagagcaaaaaatggtgtcaggttcagggatctccgcaaggagggtggtggttgacgctcgccaccatatgttgggaagattatcttcaattttggctaaggaattgttgaatggacagagagttgtggttgttaggtgtgaagagatttgtttatcagggggacttgtgagacagaaaatgaagtatttgaggtttcttcgtaagaggatgaatactaagccttctcatggtcctattcactttcgtgctccttctaagatcctctggcgtaccatccgtgggatgattccccacaaaactaagcgtggagctgctgcgcttgcccggttgaaggtttacgagggcgttccaccaccatatgacaaaatcaagagaatggtcattcctgatgctcttaaggtgttgaggcttcaagcaggacataaatactgtctcttgggcaagctttcatcagaggttggatggaaccattatgacactattaaggaacttgagaacaagagaaaggagagagcccaagttgcatatgagaggagaaagcagttggctaaactgagagttaaggccgagaaagctgccgaggagaagctcggtccacagcttgctgttattgaacctatcaagtattagagtgcaaatttagtagttatctgaggtgaaattttgctggagattgagatttcagcttatctgtttttttaaaagttgtaccgcatggtttggtattttgcttctagcaatatttgagcagactttaaattgttttaactatctttttgaagttacaattctctcatggttttattggtacagctttgttttctactccttgatagtttgcatctataagatgaatgactccattgagctgagtctctattagaaat

SEQ ID NO: 5684 - DNA, 730 bp, Artificial
  Synthetic
gacgttcagagctcgagagagtgtgtgtgtgtgtgagaggaaaaaaatggtgtcaggatcagggatttcagcgaggaggatagtggtggacgcgcgccaccacatgctcggaaggctatcctcaatcttagccaaagaactgctcaatggacaaaaagtagtagttgttaggtgtgaagaaatttgcttaagtggtggactcgttaggcagaaaatgaagtatcttaggttccttcgtaagaggatgaacactaaaccttctcatggtcctattcactttcgtgctccttctaaaatcctctggcgtactattcgtgggatgattccccacaaaactaagcgaggagccgctgcacttgcccgtttgaaggtatatgagggtgttccacccccatatgacaagatcaagaggatggtcattcctgatgctctcaaggtattgaggctccaggctggacacaaatactgtctcttgggaaagctttcgtccgaggttggatggaactattatgatactatcaaggaacttgagaataagagaaaggaaagagctcaagtagcatatgaaaggagaaagcatttagcaaaacttagggttaaggccgagaaagctgctgaggagaagcttggtcctcaacttgccattattgctccaatcaagtactgaagtctaaatatagttgttcgaacaattttgctggagattgatgttttgggttaatttgttcct

SEQ ID NO: 5685 - DNA, 703 bp, Artificial
  Synthetic
tctaaaaacccctttacttttttctccctcgagaactccgcttactttcctttacttgcttcaccccccagatcagcagccaatccccacctcttctaccggtaaaacatgtcgaccgtgagacttccttccacctgcatgttcaaagctgctcctcagactcagaaaaagagtgcatttgtgaaaatcccgtcttctctgggatctgtgaggagcatttcgatgtcctttggcttgaaagctgactctggttttagagcatcagcaaatgtgtacaaggtcaagttggtttgtccagatggtacagaacatgagttcgaagcaccatctgatacttacatcctcgatgcagctgaggaagctggagtcgaactcccttattcgtgcagggccggtgcttgctcgacttgtgctgggaagatagaatcgggccctgttgatcagtctgacggatcgtttctggacgacaaccaaatgaaggagggttatctgcttacgtgtgtttcttacccaacctctgattgtgtgatctacactcacaaggagggtgacctttactaggtatccaacttttagttatgcttcagatcttggtttaaggtaaagcagctatataatgctcttgtactcttgagtgtcaggactagagttaaatcaagaacatcttctgtttcataaatgcttttatgtaatgcagcctaat

SEQ ID NO: 5686 - DNA, 603 bp, Artificial
  Synthetic
agagctagagctcatccattctttcttcttttctagctcggaactttcgaccggcttgttcgatccaaatggcggcaattctcgcggcagcatcgccagcagcgtcgactgttcgtctcccgaccgcagcatcgacttgttccaacaagtcggcattgtctctgaccccagcaccgctctctctctccaagaagtttggcctgtcgagcagcagagctagaatagtcgccatggcatcgtacaaagtcacgctcaagctcgaaaatggcagcgagaagacgttcgagtgccccgaggacgtctacattctggaccaggccgaggaggaagccatcgatctgccaagctcttgccgcgccggatgctgctcgtcgtgcacaggaaaggtggtgagcggcaccgtcgaccaaaccgcccaggacttcttggacgattctcagatggacgagggattcgtcctcacttgtgttgccaagccaaccagcgactgtgtcatcatgactcaccaggaagatagtctgtagaagcgagaactttccccttctcgttcttggtctgcttgctcttgctcgtctcgaggatatatcgtcgctcctcctgctg

SEQ ID NO: 5687 - DNA, 670 bp, Artificial
  Synthetic
gggaaagctgaattcctctgctcaaaacttcagattttttccttacttccgttgtctactaaaagttggagtttctacaggtgcaggtatgtcgactataagcattccctcaggttctttcctcaaagttgcaccatcaataagatcatatgcctttaccaagtcccaatgctctttgggttctgtaaagagtatttctaaagcatttggcttgaagtcgtcgtcctccttcaaagtctctgcaatgacagcatacaaggttaaactggttgggcccgatggtaatgagactgaaattgaagtctccgatgatcaatacatcctcgatgcagcagaggaagctggagttgagctgccttattcatgcagggctggatcttgctgtacatgtgcaggcaagttggtttctggaacagtcgaccaatccgaaggtgcattccttgacgatgatcaaatggagaagggttatttgctgacttgtatttcatacccgagatctgactgtgttattcatacacacaaggaagaagagctcgtttgagcatgtttgttcattttgcttcaagtggggagcttgaaaattgagagtgtaattgtgccgtagacgcgtaaacgaaacaataagcagaaataaatgaagaaattggtttgctgcctcccagatggagat

SEQ ID NO: 5688 - DNA, 618 bp, Artificial
  Synthetic
cccgggccgcgcactcccaactcctctcctgtccttcccactactctcgcgaggaggaaagcgaagccaagcgagagaggcttccgccgtcgccttccccttcgccttccgatcggtcgcgaggtttcaagatggcgacgtgcacacttgcaacttcatgtgtgtccttgagcaatgctagaactcaggcctccaaggtggcggcggtcaagagcccggcatctctaagcttcttcagccaaggcatgcagtttccaagcctgaaggcctcctccaagaagcttgacgtctcggcaatggctacctacaaggttaagctcatcacaccagaagggcaagagcacgagttcgaggctccggatgacacctacatccttgatgccgccgagaccgctggagtagagcttccctactcatgccgtgctggagcatgctctacctgtgccggtaagatcgaggctggctccgtcgaccagtcggatggatcattccttgatgatgcgcagcaggaagaaggctatgtgctgacatgtgtctcctaccctaagtccgactgcgtcatccatactcacaaggaaggagacctttactaaggtgctttttcttgaaaattttctg

SEQ ID NO: 5689 - DNA, 690 bp, Artificial
  Synthetic
gaattcacaacctcaaacttgttagctacaacttctccatttctctcatcttattagaaaaatggcagcaacactttcaggtcccatggttagtacctcattcatcagaaaacaacccgtaacaagtcttcgttcaatctctaacgtaagccaagctatgttcgggctaaaatccagccgtggtggtagaataaccgcaatggctacatacaaagtgaccctagttacacccgagggaaaacaagaattcgactgtccagatgatgtctacattcttgaccatgctgaagaagttggaatcgatcttccttactcatgccgtgcaggttcctgttcttcatgcgccgggaaagtcactggaggaacactcgaccaatctgatggtagtttccttgatgatgagcagattgaagagggttgggtgttgacttgtgtcgcatacccaacatccgatgtcaccattgagactcacaaggaggaagaactaactgcttaattagttgtcccttcttcaattaattcatgacatttttcattatgtttcattttaagacaatatgtggttgtggtggtgttctgaatcctatctaaatttttctatttgtcttgattgattgtcttatgagaacatgagctataagtattatcaagtgtgctatgataattcaaaactttcattggttttatata

SEQ ID NO: 5690 - DNA, 574 bp, Artificial
  Synthetic
gtctgtcggccaccgcacgcactcgcgcacgctcgctaagtgaaaccaagctcgtaaaccacgccgccatccatggcttccctcgccttcgcatcccctgcatccaccgccacctccgcgcccgcgccattcaagatggccggtttcgcctctggccctcgtagcctcccatgtcccacccccgccttcttttcgtggccctcccccgccgtccgtagaaacgtcgcgatggcttacaagaccgttctgaagaccccctccggcgagttcaccctcgacgtccccgagggtaccaccatcctcgatgccgctgaggaggccggctacgaccttcccttctcctgccgtgccggcgcgtgctcctcctgcctgggcaaggttgtatcgggctccgtcgaccagtccgagggctccttcctcgacgacggccagatggaggaagggttcgtcctgacctgcattgccatccctgagtccgacctcgtgatcgagacccacaaagaggaagagctcttttaagccccccacacccacatccaaacccacacactcatacccattgtttaggactatg

SEQ ID NO: 5691 - DNA, 722 bp, Artificial
  Synthetic
cccacgcgtccgcccacgcgtccgctaccttacctagcagcagcagctagctagcttaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacaacagcgtgcccgagggttaattgttgttgtttaattaatgtacgttttgctgcacctgcttaatcatatccatatcacatttt

SEQ ID NO: 5692 - DNA, 409 bp, Artificial
  Synthetic
gaattcacaacctcaaaattgttatctactaattctccatttgtctcatcttattacaaatatggcggtaacaatttcaggtcccatggttagtacctcattcatcataaaacaaaccgtaaaaattcttcgttcaatctctaacgtaagccacactatgtgcgggctaaaatccagccggggtggttaaataatcgcaatggttacatacgaagtgaacctagttacaccctgtggaaatcaagaatacgactgtgcacatgatgtctacattcttgaccatgctgaataattaggaatcgatcttccttattcatgacgtgcaggttcctgttcttcatgcaccgggaaagtcactggaggaacactccatcaatctgatggtattgtccttgatgatgagtagatt

SEQ ID NO: 5693 - DNA, 821 bp, Artificial
  Synthetic
actactctcgcgaggaggaaagcgaagccaagcgagagaggcttccgccgtcgccttccccttcgccttccgatcggtcgcgaggtttcaagatggcgacgtgcacacttgcaacttcatgtgtgtccttgagcaatgctagaactcaggcctccaaggtggcggcggtcaagagcccggcatctctaagcttcttcagccaaggcatgcagtttccaagcctgaaggcctcctccaagaagcttgacgtctcggcaatggctacctacaaggttaagctcatcacaccagaagggcaagagcacgagttcgaggctccggatgacacctacatccttgatgccgccgagaccgctggagtagagcttccctactcatgccgtgctggagcatgctctacctgtgccggtaagatcgaggctggctccgtcgaccagtcggatggatcattccttgatgatgcgcagcaggaagaaggctatgtgctgacatgtgtctcctaccctaagtccgactgcgtcatccatactcacaaggaaggagacctttactaaggtgctttttcttgaaaattttctgccaagaggcaaaaaactctcaatgtcgtcggcaaggtccatcgtgtgtaccagttgtctcaactctcaattaaatcggactttgatggtggttttgaatgttgtctttcgttagtatgcgtttcaaggttggggctaagagatgggaacccaatggtaatactagctagtcaataataaccagctgctatggcgtaatacaattcgtggttttggatataatttgcaatattattatcttca

SEQ ID NO: 5694 - DNA, 607 bp, Artificial
  Synthetic
aaattctcagcttatagtcaggtgaggtctgagctgaggttgagagatggcacaggcaatggcgtccatgaccgggctgtcgcagggcgtgcagctgccggccgggcccaggcgcgccggcggcaggtccaggctcgccgtcgtcagggccgacgccgccgccgccgacgtccagaccggccgccgcgccgtgctcggcctcgtcgccaccgggatcgccggcggcgccctcgcgcaggcggcgctcgccgaggccgccaagcccatcaagctcggccccccgccaccgccctccggtggactccctgggacgctgaactcggaccaggcgagggacacggacctgccgctgagggagaggttctacctgcagccgctgccgccggcggaggcggcggcgagggcgaaggagtcggcccaggacatcatcaacctcaagccgctcatcgagaagaagcagtggccgttcgtcagggacgacctccgcctcagggcctcctacctgcgctacgacctcaaaaccgtcatcaactccaagcccaaggacgagaagaagggcctcaaggacctcaccggcaagctcttcgccaccattgacgggcttgac

SEQ ID NO: 5695 - DNA, 873 bp, Artificial
  Synthetic
cccgatctgaagagagaaattctcagcttatagtcaggtgaggtctgagctgaggttgggagatggcacaggcaatggcgtccatgaccgggctgtcgcagggcgtgcagctgccggccgggcccaggcgcgccggcggcaggtccaggctcgccgtcgtcagggccgacgccgccgccgccgacgtccagaccggccgccgcgccgtgctcggcctcgtcgccaccgggatcgccggcggcgccctcgcgcaggcggcgctcgccgaggccgccaagcccatcaagctcggccccccgccaccgccctccggtggactccctgggacgctgaactcggaccaggcgagggacacggacctgccgctgagggagaggttctacctgcagccgctgccgccggcggaggcggcggcgagggcgaaggagtcggcccaggacatcatcaacctcaagccgctcatcgagaagaagcagtggccgttcgtcagggacgacctccgcctcagggcctcctacctgcgctacgacctcaaaaccgtcatcaactccaagcccaaggccgagaagaagggcctcaaggacctcaccggcaagctcttcgccaccattgacgggcttgaccatgcagccaagatcaagagccccgaagaggcggagaagtactacacgttgaccaaatctgctcttggcgatgtcctcgccaagctaggctaggatcggcataatggccatatggggtttcggtgtttttatgtttgttcatatggaaccggcaatgtaccctccatgttgatattgtatcagcaagcacttacgtatgattcaatcttgagttgttgttgacggctaaatctccaagcaggcgcgatta

SEQ ID NO: 5696 - DNA, 764 bp, Artificial
  Synthetic
ccgggggcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactccaaaactgtctcgagtttgaacaatgttcttgccaagctcggttaatgaagaaagacttgcgttgtaatctgttgatgtcgatgttattataattac

SEQ ID NO: 5697 - DNA, 648 bp, Artificial
  Synthetic
gaattcagtagctcacaagctgtcttggaaggtagccttcaactcaacagctctacccgcttgagtggagttagtaacaaccgagtaagcgtgatcagtcgatctagtttcacagttaaagctcagtcatcggacaatgaagccgtagctcagagtagtcgcagagctgtcttgggactagtagctaccggattggtaagtggctcattcattcagcgtgtgcttgctgaagcaaggccaattaaggtcggatcacctcccaagccatccggtggattgcctggaactcttaactcagaccaggctagagaccttgatctaccattgaaggagaggttcttccttcaaccactgtctccaacagaggctacacaaagagctaaagaagctgctaaagagattcttaacgtgaagagtaacatagacaagaaggcatggccttacgttcagaacgatcttcgttcccaggctggatatcttcgttatgacctcaaaactataatttcttcaaagtccaaggatgagaaggcttcgcttacagatctcaccaacaaactctttatttcccttgacaaactggacaatgcagcaaagatcaaaagcagtgaagcagcagcaaagagttatgccgatgctgtagtgtctttg

SEQ ID NO: 5698 - DNA, 573 bp, Artificial; identical to SEQ ID NO: 4212
  Synthetic

SEQ ID NO: 5699 - DNA, 611 bp, Artificial; identical to SEQ ID NO: 4211
  Synthetic

SEQ ID NO: 5700 - DNA, 666 bp, Artificial
  Synthetic
aaagaggaaggaaggaaggaaaggatgtccatcgccgccgacctgccgttccctgctatggcgaccgtcgtctgatctacccctttcctttccctcctcgccgatatggcgtcccgcccccgtgcagactatgacttcctcgtcaagctccttctcatcggggacagcggtgttggaaaaagttgccttcttctccgattctctgatgattctttcaccacaagctttattactacaattggaattgatttcaagattagaacggtggagatagatgggaaacggatcaaattgcaaatctgggacacagctgggcaggaacgctttcgaacaataaccacagcatactacaggggtgccatggggattatccttgtgtacgatgttacagacgagtcttcatttaacaacattgggaactggatcaggaacattgagcaacatgcctctgagaatgtcaacaaaatattggtgggcaacaaggctgatatggatgaaagcaagagggctgtttcatttgcaaaaggcaaagctcttgccgatgagtttggtatcaagttttttgaaacgagtgcgaagacaaacatgaatgtggaggcgtcctttgtcacaattgcaagggatatcaaacagcggctttcggagtcagacttcaaaccacagccc

SEQ ID NO: 5701 - DNA, 592 bp, Artificial
  Synthetic
ttcctcgattcgaagaacaagaagcagaaggagaagaagaggaagaaggaatagccctacccttatcgctcaacggaaaataattcctgccccccataataataataataataatacctttcaatccattcaattgcttccgataattcccctctcttcccaattcgccggccatccgggttcaaaactccccgtggggaacgcgcagcactgtttttcagcctacccatcgacgacccttgtgaagatgtcctaccagtatctcttcaagtatatcatcattggcgacacaggcattggcaaatcatgcctcttgttgcagtttacagacaagagatttcaacctgtacatgatcttaccattggagttgagtttggggctcgtatgatcacaattgggaacaagcctattaagttgcagatttgggatactgcaggacaagaatcatttcgatctatcaccagatcatactaccgcggtgctgcgggtgcattgctggtctatgatatcaccaggcgagaaactttcaaccatcttgcaagctggctggaagatgctcggcaacatgccactacaaatatggttatcatg

SEQ ID NO: 5702 - DNA, 648 bp, Artificial
  Synthetic
gttgcaacctgcgagcggaaacccacctccaccccgtcgccggcctgccgccgccgccgccgccgcttgccctcctccgccttactcggcctccggcgcctcctgaccccccggccatgggttgctcttcgtctctgccagctaataatgctggaggggtaggtactatcagcaacgagaattctggtactgatctgaagaacttgcgagtgaagttggtattgcttggagattcaggtgttgggaaaagttgcattgttcttcgctttgtccgtggtcagtttgaccccacttcaaaggtgactgttggtgcatcatttttgtcacaaacattggcgttggaggattccacaacagtaaagtttgaaatatgggatactgctggtcaggagaggtatgctgcattggcacctctttactaccggggagctggtgccgcaattgttgtgtatgacataacaagttcagaatcatttaacaaggcacaatactgggtgaaggaacttcagaaacacggtagtccagatatgatcatggctttggttggaaataaggctgatctacatgacaatcgtagtgtatcctctcaggatgcacaagagtatgcagagaggaacactatgtttttcatcgagacatcagcgaaaa

SEQ ID NO: 5703 - DNA, 720 bp, Artificial
  Synthetic
  misc_feature (660)..(660): The residue at this position can be any nucleotide.
aatatcaaaagggaaaaatacaaacctaaaaaagggttcaccttttgttaatttgattttttcaccatgtctatgcgtaggagaaccttgcttaaagtcatcgtcctcggcgatagtggggttggtaaaacgtcattaatgaatcaatatgttcacaagaagttcagccagcaatataaagctacaattggagctgatttcgtgacaaaggagcttcaaattgatgacaggcttgtaactctccaaatatgggatacagctggccaagagagatttcagagtcttggagttgcattctatagaggtgcagattgctgtgttttggtctatgatgtcaatgttatgagatcctttgataaccttgacaattggcatgaagaatttctcaaacaggctaatccaccagaccctaaaacatttcctttcatattactggggaacaagattgatatagatggtggaaatagcagagtggtttctgagaagaaagcaaaggaatggtgtgcttcaaaagggataccttactttgagacatcagcaaaagaggatataaacgttgatgctgcattcttgtctattgcaaaaactgctttggccaatgaacacgagcaagatatatacttccagggcattccggaggcagtttcagagacagagcanagaggtggttgtgcatgttaaggtgaatgaagcaatttcattgagtgctatatgtaatcg

SEQ ID NO: 5704 - DNA, 646 bp, Artificial
  Synthetic
gcaagatcccagcaaagactagccaagatctgcgtctcctctctctctctctctctctctctctctctctaactttcaactgctgattgagtgcacagaagcttagtgttctggtttaaaaaaagatggcgagtgggtatggggatgcgagccaaaatatagattatgtattcaaagtggtgttaatcggcgactcatctgtaggcaagtctcagatactggctcgatttgctcgtaatgaatttagcctggattctaaggccacgattggggttgagttccacacccgaaccctagtcattcaacacaagtctgttaaagctcatatctgggatactgctggtcaagaacgatatagagctgtcacaagtgcatactacaggggcgcagttggagctatgttggtttatgacataacgaaacggcaaacctttgatcacataccccgttggctggaagagttgcgcgcacatgccgataggaatatcgagatcatgctgatcggacacaaaacagatcttgaacaccaacgagctgtccctaccgaagatgctaaagaattcgcccagaaagaaagattattcttcttggacacttctgcaatggaagccacacacgtggaggatgcattcttgactgttttgac

SEQ ID NO: 5705 - DNA, 720 bp, Artificial
  Synthetic
gatcgatcgatagaatcgactctagggtttagcagcagcagcagctcgtcgattctttcctccttcttgattgatcatggcgcggcggccggatgaggactacgactacctcttcaaggtggtgctcatcggcgactcgggcgtcgggaaatccaacctgctctccagattcacgcgcaacgagttctgcctcgagtccaaatccaccatcggggtcgagttcgcgacccgcacgatccaagtggacggcaagacgatcaaggctcagatctgggacacggccgggcaggagcgttaccgcgccattaccagcgcctactaccgcggcgccgtcggcgctctcctcgtctacgacatcaccaagcaggcgacgtacgagaacgtggagcggtggctcaaggagctgcgcgaccacgccgactccaacatcgtcatcatgctggtgggcaacaagtcggaccttcgccacctccgcggcgtgacgacggaggacgcgcaggccttctccgagagggaggggctgtcgttcatcgagacgtcggccctggaggcgaccaacgtggacaaggcgttccagagcatcctgggcgagatctaccggatagtgagcaagaaagcgctggcgacggcggacgagctgtcgtatgtggctccgggcgaaggcaggccatccacgtcgggcccgagcaggatggcggcgccgtcaagaagaaggcgtgc

SEQ ID NO: 5706 - DNA, 894 bp, Artificial
  Synthetic
acgcgtcgaggctggaagcaagcgatcttttatttctcttctcctctcgccagatcgatcgccgccggctcaggccagttcttccgggagatccagcgctatggcctacagatcggacgaggactacgactatctcttcaaggtagtgttgattggcgactcgggcgtcggcaaatccaacctcctctccagattcacgcgcaacgaattcagcctcgaatccaagtccaccatcggggtcgagttcgcgacccgtagcatcaacgtcgacggcaagctcgtcaaggcacagatttgggacaccgccgggcaggagagatatcgagcgatcaccagcgcctactaccgcggcgccgttggcgctctcctcgtctacgacatcacccggccggtgacgttcgagaacgtggagcggtggctcaaggagctcaaggaccacaccgattccaacatcgtggtgatgctggtggggaataagtccgacctgcgccacctccgggccgtgtccaccgaggacggccaggccttctccgagcgcgaggggctctacttcatggagacgtcggccctcgagtcgaccaacgtggagaatgcgttcaagcagatactgacgcagatttaccgggtggtgagcaagaaggccctggatgtcggcgaggacccctccgccgccccggctaaaggacagactatcaacgttggcggcaaggacgatgtcacggctaccaagaaggttgggtgctgctccacctgaatcatggtcgacgttttagctggtttcgattgatctggtagctacaggtgggaagtttagatcagacagctggttcttgatagctacgaattcttttgctctactaggtagcaaattctttaaatactttttcttaactt

SEQ ID NO: 5707 - DNA, 208 bp, Artificial
  Synthetic
aagaatcatttagatctatcacaagatcttactatcgaggagctgccggtgctctacttgtctatgatatcaccagaagagaaacttttaatcatcttgcaagttggttggaggatgctcgcactcatgcaaactccaacatgacaatcatgctcatcggcaacaagtgtgatctttctcatcgaagagcagtcagcaccgaggaagg

SEQ ID NO: 5708 - DNA, 595 bp, Artificial
  Synthetic
attgtgagagtagcacaggagtttagtttggattcgggctcggggcgagaagaatgtcggatttcgatgtgaagatcgactatgtgttcaaggtggtattgattggcgactccgccgtcggcaaatctcagctgctgtcgagattcgcgcgcgacgagttcaccctcgactccaagtccacaattggcgtcgagttccagacccgcaccatctccgtcgacggcaagaccatcaaggcacagatctgggacaccgccggccaggagaggtacagggcggtgacgagcgcttactaccgcggcgcggtcggcgccatgctggtttacgacatcacgagaaagcagacgttcgagcacgtagcgcggtggctggaggagctgcggaaccacgccgacaacaacgtggtgatcatgatggtcgggaacaagtcggatctgaccgacaagcgggccttgtctttggaggaggcgcgagagtttagcgagaaggaggggctctacttcatggagacgtcggcactcgactcgaccaacgtcgagacagccttcatcaccgtgctcacggagatctacaagatcgtcagcaagaagagcct

SEQ ID NO: 5709 - DNA, 450 bp, Artificial
  Synthetic
aagaagaccgagttagagaagaacagggtagagaaagaagaagagttggagaagatgtcgtcagcagtgaggccgggacccggcgcagaccacgactaccgcatcaagctgctgctcatcggcgacagcggcgttggcaagagctgcgtgctgctccgcttctcggacgactcgttcacgacgagcttcatcaccaccatcggcatcgacttcaagatccgcaccatcgagctcgacggccgccgcgtcaagctccaggtgtgggacaccgccggccaggagcgcttccggaccatcaccaccgcctactaccgcggcgccatgggcatcatcctcgtctacgacgtgaccgacgagtcgtccttcaacaacatccgcaactggatcaagaacatcgagcagaacgcgtcggagaacgtctcccgcatcctggtcgggaacaaggccgac

SEQ ID NO: 5710 - DNA, 818 bp, Artificial
  Synthetic
agggaagatcatcgtgcatcgcgcggaggtctggatcggcagcgctaatggcggcggggagagcgcgggcggactatgactacctcatcaaattgctgctcatcggcgacagcggtaagagaaagaatttcgatccggcgggggaagtctttgtctagcagctagatctctgctcgatctgcacgaaatatcgatgagctgatggatttggtcgccgcatttctctctgcccgcaggtgtggggaagagctgccttttgctgcgcttctcggacgattccttcacgacgagcttcatcacgacgataggcattgacttcaaaatcaggaccgttgacctggatggcaagaggatcaagcttcaaatttgggacaccgctgggcaagaacgcttccggacgatcacaactgcatactaccgaggagctatgggcattcttctcgtctacgatgtgacggatgaatcatcgttcaacaacatccggaactggatcaggaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagactagcggaaacagactccagacccgagcctcccaggatcaacaacgtaatactagacccgtcgaaggatcagaacaacaacaaagacaagtcatcatgttgcacctgagagcaag

SEQ ID NO: 5711 - DNA, 645 bp, Artificial
  Synthetic
ctgcttagacttcagtgaggccagcatattctgtaggttccatccagaggaagaaaatggggtgtgctgcttccaggccggtgaaaggcttgcaaaatctgaacgacagtgctcaggagcacgatgccaaacacttgagggtcaagctggttcttctgggagactctggagtaggaaagagctgcattctcgtgcggtttgtgaagggccagtttgatccatcatcaaaggtcacagttggtgcttcctttctgtcgcaaaccatagctctccaagactcaagtacagtcaagttcgagatatgggacaccgcaggacaagagagatatgcttcgttagcaccgctctactacagaggagcgtctgcagccgttgtagtctacgacctgacgagcaaggaatcgttccagaaggctcagtactgggtcaaggagttgcagaaacacgcgaactctggaattgtcctggcgctcgttgggaacaaagccgaccttgaagactcgcgtgcggtctcgtcagatgaagctcggtcatacgcagagagcaactccatgtacttcagcgaggtgtcggcaaaaactgccgacaacatcaacgcgcttttcgaggaaatcgcaaagagacttcctcggcctggaaagcaat

SEQ ID NO: 5712 - DNA, 700 bp, Artificial
  Synthetic
ggcaacacgaggaggtcgtagggtttgcgggagagctctcgccgaaggcctgatctgtgctgggatctacaccaggagctcaagcatggcatccaggaagcgaactctcctcaaggcgatcattctcggcgacagcggcgtcggcaagacatcgctcatgaatcaatacgtgaacaagaaatttagcaaccagtacaaggcgaccattggagctgattttctcaccaaggaagtccaagtggaggataggctagtgacgatgcagatatgggatacagccggtcaggagcgattccaaagccttggtgtggccttctatcgaggggctgattgctgtgtgttggtatacgacgtgaatgtgatgaagtcgttcgataatctggacaactggcgcgacgagtttcttatccaggcaagtccttctgatccagagaacttcccttttattgttctcggcaacaaggtcgatgtagacggggggaacagcagagtggtatccgagaagaaagccaaggcctggtgcgcgtcgaagggaaacattccatactttgagacgtctgccaaagaagactacaacgttgaggctgcttttcaatgtatagcgaagaatgccttgaggagtgaacccgaagaagacttctaccttccggacacgaatgacctcgcaaacaacaacagagtgacgagatcatctgggtgt

SEQ ID NO: 5713 - DNA, 791 bp, Artificial
  Synthetic
ggcggatcggtgggttgcgggcttgcacgtagtcgaggctcgagaggagggggggatggcggcggcggcggcggcggcggggtacagggcggaggaggagtacgactatctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttg

SEQ ID NO: 5714 - DNA, 514 bp, Artificial
  Synthetic
gagcaaaagccagcctcgtcattgaagcctcaaagtataggcagccggcattcaaggtctcgtgacgcttgcgacgctgatttcttccatcacactaccggacactcttttttcgatatccatcatcacctttccgccaccagaagcacccggagaaggcctcttcgctcgcggcggctgtgcttttggctcatatctatcacgtcattggagccccgagtgtacgacgataaccagtcaagatgtcttcgcgcaacaagaaggtccttctcaaggtcatcatccttggagatagcggtgtgggcaagacgagtttgatgaaccaatacgtcaacaagaagttcagcacaagctacaaagcgactatcggcgctgatttcttaacgcgagaggtcctggtggacgaccgacaagtcaccatgcagctctgggacacagccggacaagagagattccagtctctgggcgtcgcattctacagaggagccgactgctgcgttctggtgtacgatgt

SEQ ID NO: 5715 - DNA, 698 bp, Artificial
  Synthetic
cacaaccacacatctcagcgtcacagcttcccttgtctgcacagcatcaaaccaccttttctcacctgcgcgcatcgactcgttctgctgctaccatggccaacgacgaatatgatgtaggttccgcccccttctcgcactgcaacgaaatgaacacctggcggaacgctaacggcgatgcttcaacccccactagttcctcttcaaagttgtcttgattggtgactctggagtcggaaagtccaatcttctcagccgattcactcgcaacgaattcaacctcgactccaagtcaactatcggtgtcgagtttgccactagatcgatccaggtcgactccaagaccatcaaggcgcagatttgggatacagccggtcaggagcgttaccgtgccattacttccgcatactaccgtggtgcagtcggcgccctcctcgtctatgacatcagcaagcaccaaacctacgagaacgtcacgagatggctaaaggagcttcgggaccatgccgatgcgaacattgtcatcatgctggttggcaacaagagcgatttgagacacctgagggctgtgcccacggatgaggccaagggctttgctagcgagaaccatctttctttcatcgagacgtccgccctcgacgccagcaacgttgaacttgccttccagaacatccttactgagatctaccgaatcgtat

SEQ ID NO: 5716 - DNA, 524 bp, Artificial
  Synthetic
tgcaaagaactcgcccgcagctgagaggggggaataatccataatccgccagcccacgcacatcgccaggcaaatctgcactcttctgcacctccaagaggagtcgcttttgctgcatctccaaagtcgcaagcagacgccgccgaaacgagccggtaaaagatggcggaagctcccaaacccagcagcagcgtcaagctggtgctcctcggtgaagccgcagtcggaaagtcatccctcgtcttgcgattcgtcaacaacgacttccaagagaacaaggagccgactattggtgcggcgttcctgacgcaaaaatgcaacctggccacccgaaccatcaagtttgagatttgggataccgctggtcaagagcgatttgcctctctggcgcccatgtactacagaaacgcccaggccgcccttgtcgtctacgacatcaccaagcccacatccctcgtcaagggccgacactgggtcgccgagctccaacgacaagcctcacccggtatcgtcatcgccctggt

SEQ ID NO: 5717 - DNA, 609 bp, Artificial
  Synthetic
ctttcctagtcttcttctccgccactccgaggcggcaaggaggaagatctcggaggcggtgcccggaggaggtgaggcgagatgggcgggcgggtggatcacgagtactcgtacctgttcaagatggtgctgatcggcgacagcggcgtcggcaagtctaatatcctctcccgcttcacccgcaaccacttctccctcgactccaagtccaccatcggcgtcgagttcgccaccaaatccctgcagatggagggcaaaacaataaaggctcagatctgggacacagcaggacaggagagatatcgtgccatcacaagtgcttactaccgtggcgctgttggggctctccttgtttacgacatcacaaagaggcagagcttcgacaatgtccacaggtggcttcgtgagctccgcgaccatgccgactcgagcattgttatcatgatggtcggtaataagtctgatttgattcatctaagggctgtctccgaggatgaaggtaaggcattggctgaaaaggaggggctgttttttcttgagacatcagctatggaggccgtgaatgtggaggaagcctttcagactatcatcacagaggtctatggcatt

SEQ ID NO: 5718 - DNA, 568 bp, Artificial
  Synthetic
aaagagggaagatcatcgtgcatcgcgcggaggtctggatcggcagcgctaatggcggcggggagagcgcgggcggactatgactacctcatcaaattgctgctcatcggcgacagcggtgtggggaagagctgccttttgctgcgcttctcggacgattccttcacgacgagcttcatcacgacgataggcattgacttcaaaatcaggaccgttgacctggatggcaagaggatcaagcttcaaatttgggacactgctgggcaagaacgcttccggacgatcacaactgcatactaccgaggagctatgggcattctcctcgtctacgatgtgacggatgaatcatcattcaacagaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagact

SEQ ID NO: 5719 - DNA, 666 bp, Artificial
  Synthetic
gtctcctcgacggttatcgatcgatctctcgcggttgatcgatctctcacatcgatcgcctcgatctgatgcgttgctggctgcattccaggttaatccggcggatcgatgaggatttccgcgatcgccgcggcagttctcgcggcgattctcgcgctggctctttctggagctgcggagatcttcttcgaggagcgattcgacgatggttgggaacatagctgggtccagtccgattggaagcgatccgacggtctagcggggagctggcgacacacagcagggaaatggcatggtgatccagatgataaaggcatccagacttatcccgatgctcgatacttcgccatctccgcgcagttccccgagctcaacaccaaaggaaagacgctcgtaattcagtactctgtgaagcacgaacaaaagatcgagtgtggtggcggctatatcaagctactcagtggttacgtgaatcagaaacggttcagtggggatacgccttacagtatcatgtttggtccggacatttgtggcactcagaccaagaaggtccacgcgattttgcagtataagagccagaactatccaatacggaaggaagttacttgcgagacggaccagctcactcacgtttacacgttggtaattcgtcccgacgcaacttac

SEQ ID NO: 5720 - DNA, 284 bp, Artificial
  Synthetic
cgggacatgggctggtgatcctgatgacaaaggtatccagacaacaaacgatgccaaacattttgctgtctctgcaaaggtaccggaatttagcaataaaaacagaacactggttgtccagtattctataaagtttgagcaagatattgaatgtggagggggttacataaagcttctctctggatatgtcaatcagaagaaatttggtggagacactccatacagttttatgtttgggccagatatctgtggtacacagacgaagaaacttcatgttatgcttt

SEQ ID NO: 5721 - DNA, 563 bp, Artificial
  Synthetic
gttgccttctcttggtactcttccccttggcctctttcgcccacgttttcttcgaagaacgcttcaatgatggatgggagaacggatgggtgaaatcggattggaaaaaggatgaaggtgctgcaggagactgggtacacacggcagggaaatggagtggtgactccgaagacaaagggattcaaaccaatccagacttacgattttttggcatatcaactgagtttcctgaatttaacaacaagggcaaggatttggttgtccagttttctgtaaagcatgaacaggatcttgattgtggtggaggttatatcaagcttttaagtggtgatgtggatcagaaaaagtttaatggtgataccccgtacagcatcatgtttgggcctgacttctgtggctatagcacaaagaaagtccatgttattttgaactacaatgacaagaatcaccccattgagaaggaaatttcttgtgaaaaggatcaactgacacatgtctacactcttgtgataagacctaacaacacctacagtgttctaattgataatgaagagaaacaaaac

SEQ ID NO: 5722 - DNA, 609 bp, Artificial
  Synthetic
taaaactagtcttctcagctgaatcatttctactagttttgttacttttctcacttctcagctcttcattctctgagatcttttttgcagaacagttcgatgatgattggcggagcagatgggtgaagtctgactggaaaaggagtgaagggaaagcaggttcatttaagcatacagctggaaaatgggctggtgatcctgatgataaaggtattcagacatcaagcgatgccaaacatttcgccatttctgctaaggtaccagaatttagcaacaagaacagaactttggttgtacaatattctataaagtttgagcaagacattgagtgtggtggaggttacataaagcttctctctggatatgtcaaccagaagaaatttgggggagacaccccttacagtatgatgtttggaccggatatctgtggtacacagacaaagaaacttcatgttatgctttcctatcaaggccagaattatcccatcaaaaaggatctacaatgtgaaacagacaaattaacccatttctacacattcattcttagacctgatgcatcatacagcatctggattgatggtcgagaaagggattctggaagcatgtata

SEQ ID NO: 5723 - DNA, 638 bp, Artificial
  Synthetic
attcttgaccaaagaaatatggctctccccatagtttcctgcttattctttcttcttatgatctcctctgcaacagcgtgcgatcgctgtgtccaccaatcaaaggttgcttacttttccaaggcttctgcccttcagtctggtgcttgtggttatggctcctcagctataggctttaatgggggtcggcttgcagcagcagttcctagtctctacaaagagggagctcgttgtggtgcttgttatcagataagatgcaagaattcaaaactttgttcaaaagaaggcacgacggtgactgtaactgatcagaataccaacaaccagacagattttgtagtcagtagtagagctttcagcgccatggcaaatcaaggcaaagctcaagaccttctcaaactcgctgtctttgatgtcgagtacaaaagggtgccttgtgatttcaaaaacaagaatttggctattcgggtggaacaatcaagcaaaaacccaaattatctagcaattaccttcttgtatcaaggaggtcaaactgaaatcgttggtgttgatgtagctcaggtaaactactaacccagtactatacacataaattattttcgagtttagtagaaaaattgggtattttacgaattaag

SEQ ID NO: 5724 - DNA, 813 bp, Artificial
  Synthetic
aaaagttgcttacttttcagtgcctccgcccttcagtctggtgcgtgtggttatggagatttagcaataggctttaatgggggtcgacttgctgctgctattcctagcctttacaaagaaggagctggttgtggtgcttgttatcagattagatgcaaagactcaacactctgttcgaaagagggcacaactgtaattgtaactgatctaaataccaataaccagacggattttgtgatcagtagccgagcttttatggccatggccaataagggaaaagctaaagacgttctcaaattgggaattgctgatgttgaatataaaagagttccatgtgattacaaaagcaagaatttggccattcgtgtggaagaatcaagtcaaaaaccaaattatctagcaatcagcttcttgtaccaaggtggtcaaactgaaattgtcgctgtcgacgtagctcaggttggatcatcgacctggaatttcctgagccgaaatcacggagcaatttgggacacaagtagagtgccaacaggggcattgcaatttaggtttgtggtgacagcagggtatgatggcaaatggtattgggcaaaatcagtgttgccagcagattggaaaaatggggtaatttatgacactggacttcagatcactgacattgctcaagaggcttgttctccatgtgatgatggaaactggaaacttcattagtgttaaaaataaaaaaattattttagctataataatctatgtgaatacacgtggtaaaagtaaaagagatcctaaattaataaaattgtagattgatgcagt

SEQ ID NO: 5725 - DNA, 404 bp, Artificial
  Synthetic
tggtatcaacgcagagtggccattacggccggggcaccaccaacttattcttatattgcttaactctctttcttatgctctttaattttcaaatggctcctcttcaagttcttgcaatatttttcatttcttttattttcatgcaaatttatttgggaaatgctcaaacattcatccattctaaagcagcttattatccaaattcagaagaaaaaggaacggaaactggggcatgtggatttggtacttttggagcaacaatcaacggtggagatgtatcagctgcatcagatctttatcgagatggtctaggatgtggcgcatgctaccaggtgaggtgcacaaacagtaactactgctcggataatggagttactatagttataactgaccatggagcaagt

SEQ ID NO: 5726 - DNA, 804 bp, Artificial
  Synthetic
tccacattctctcaactttctctttctaaaaactcttcctatctctttctctagcacacagaccatcaatggcatcgccgcgcgaggagaacgtgtacctggcgaagctggctgagcaagccgagcgctacgaggagatggtagagttcatggagaaagtcgtcggcgccggcgacgacgaactcaccgtcgaggaacgcaacctcctctccgtcgcgtacaaaaacgtgatcggagcgaggagagcgtcgtggcgcataatctcatcgatcgagcagaaagaagagagtcgcggtaatgaagatcatgttgcctccattaaaacctacagatctaagatcgaatctgaattgacttcgatctgtaacggtatccttaagttgctcgattcaaaactcatcggcaccgctgctaccggtgactctaaggttttttatttgaaaatgaagggagattattacaggtacttggctgagttcaaaaccggagctgagagaaaagaagccgccgagaatactctttcggcttacaagtcggctcaggatattgctaatgtcgaattagcccctacacatccaatccgattggggctagctctcaatttctcagtgttttactatgagatattgaattctcctgaccgtgcttgtaatcttgccaaacaggcatttgatgaggcaattgcggagcttgacacccttggagaggagtcttacaaggatagcaccttgattatgcagcttcttcgtgataaccttacgttgtggacctcggatatgcaggatgatggaactgatgagatca

SEQ ID NO: 5727 - DNA, 704 bp, Artificial
  Synthetic
agagaaccaaaaagaaaggggaaagtggaaagagaagaatctcctttggctcacagaaatcggacatggcttcctccaaagaacgcgagaacttcgtctacattgccaaactcgccgagcaagctgaacgatacgacgagatggttgatgcaatgaaaaaggttgcaaatatggatgttgaattgactgtggaggagaggaatttgctttctgttggatataagaatgttgttggttcgaggagagcatcatggaggatcttatcctctattgagcagaaggaagagtcaagaggaaacgagctgaatgctaaacggatcaaagagtaccggcataaggttgagaaggagctaactgacatttgcagtgatatcatgactgttatcgatgagcatctaattccctcatgtcctgctggagaatcatctgtgttctactacaagatgaaaggggattattatcgctaccttgcagagttcaaaactggtaccgataagaaagaggtgtctgatctttctttgaaggcatatcagtcagctacaacaactgctgagactgaattaccacctacccatcccattaggttgggtttggctttgaatttctctgttttttactatgagatcctgaactctcctgaaagggcatgccaccttgcaaagcaggcttttgatgaagcaatatcagagttagatagcctgaat

SEQ ID NO: 5728 - DNA, 642 bp, Artificial
  Synthetic
  misc_feature (525)..(525): The residue at this position can be any nucleotide.
tttctctctctctctctctctctctctctccctccgtcgacatgggcatcgagatggagcgagagagccttgtctacctatccaagctctccgagcaggcagaacgctatgagaaatggtggagtcgatgaagaaagtatttaagttggatgtagagcttacgattgaggagaggaatttgctctcagtggggtataagtattttatcggagcgcgaagggcctcgtggcgaattctctcctccattgagcagaaagaagagagcaagggcaatgagaccaatgtaaaacgcatcaaggagtaccgcaacaaagtggaggaagagctttccaagatttgcagtgacatcctaactatcatcgatgagcatcttatcccctcatctggcacagcagaatctaccgttttctattacaaaatgaaaggggattattatcgctaccttgctgagttcaagacaggacatgagagaaaggaagctgcagatcaatctctgaaagcttatcagactgcaagtgacacggncaacacggctctgccatctacccatccgatcaggcttggacttgcactcaacttttcagtcttttactatgagattttgagttcgccggagcgtgcgtgccatcttgccaagcaagc

SEQ ID NO: 5729 - DNA, 723 bp, Artificial
  Synthetic
gtccatctttgtgttgtgaaagaagcttgcaggccatggggacggagaaagagcgcgagaaaaatgtgtacatggccaagcttgctgagcaggcagagcgttatcaagagatggttgaatacatggaaacagtggccaagcttgatcttgagctaactgtggaggagcgcaaccttctgtctgttggctacaaaaatgttattggagcccacagagcctcttggcgtatcctttcttccattgaacagaaagaagagaacaagggcaatgagactaatgtgaagcgtaccagggattataggcataaagttgagacagaacttaccaagattagcagtgaaattttgactatccttgatgagcatctcatcccctcatcgggaactggcgaatcatctgtcttctactataaaatgaagggcgactactaccgttacctggcagagtttcagacaggcgagaagaaaaaggaatctgcggacgagtccttcaaagcatatcaggccgcatcaagcactgcaaacacagatctcccgcccacccatccaatcaggctggggcttgccctgaacttttctgttttctactatgaaattatgaattcccctgaacgggcatgcgagcttgctaaacaagcatttgatgaggcgattgctgagcttgacactctgagtgaagagtcatacaaggacagcactctcattatgcagctactgagagaca

SEQ ID NO: 5730 - DNA, 700 bp, Artificial
  Synthetic
gaggagctcgtcttcatggccaagcttgctgagcaggccgagcgctacgatgagatggctgagttcatggagaaggttgcctccatgtccagctctggtgacgagctcgctgtcgaggagcgtaacctcctctccgtcgcgtacaagaacgttgtcggtgcccgccgcgcctcctggcgtattgtctcctccatcgagcagaaggaggagaacaagggcaaccaggatcacgtctccgccatccgcggataccgcaccaagatcgagaatgagctcgccggcatctgtgagggcgtgttgaaggtcctcgcctctgccctcatccccgcctgcgcctccaaggagtccaaggtcttctacctcaagatgaaaggggattactaccgataccttgctgagttcaagaccggccccgagaggaaagacgcggctgagtccacacttctctcatacaagtctgctcaggacatcgcactcactgagatgcctcccactcacccgattcgccttggcctcgcactcaacttctctgtattctactacgaaatcctaaactcacccgaacgggcttgcagccttgctaagcaggcatgtgatgaggccatttctgagctggacacacttggtgaggagtcctacaaggacagcaccctaatcatgcagcttctccgggataacctcactttgtggacatcagatc

SEQ ID NO: 5731 - DNA, 907 bp, Artificial
  Synthetic
tacaaaactccctctctcatttcctctctcatagcaacatcaatggcgtcgccacgcgaggagaacgtgtacatggcaaagcttgccgagcaagccgagcgttacgaggagatggttgagttcatggagaaagtcatcgccgccgccgacggcgccgaggaacttaccgtcgaagaacggaacctcctctccgtcgcatacaaaaatgttatcggagcacggcgagcctcgtggcgtatcatctcctccattgagcaaaaagaggagagccgcggcaacgaagatcacgttgcctccatcaaggagtacagatctaagatcgagatcgaacttacctcgatctgtaacggcattctcaagctcctcgattctaagctcattggcgccgctgctaccggtgactctaaggtgttttacttgaaaatgaaaggagattatcatcgctatttggctgagtttaaaaccggcgcggagcgaaaggaagccgccgaaaatactctctcggcttacaaatccgctcaggatattgcaaataccgagcttgctcctacacatccaatccgattgggacttgctctcaatttctctgtattttactacgaaattttgaattctcctgatcgtgcttgtaatctcgccaaacaggcttttgacgaggcaattgccgagctggacacattgggcgaagagtcctacaaggatagcactctgatcatgcagcttcttcgcgataacctcactttatggacttcagatatgcaggatgatggaactgatgagatcaaagaagcagcaaaaccagataatgagcagcagtaaaccggtgacatttctttaggattgaaattcatgttgtaactttttatttttcaattgtctgagttcagctcttttagttctagatctt

SEQ ID NO: 5732 - DNA, 530 bp, Artificial
  Synthetic
acgagattctaaactctccagacaaggcttgcaaccttgctaagcaggcgtttgacgaagccatctctgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccattgatttagatgcctcatgctgctgtcaccatgatggatggattcttcttctgttctactagaatgtttttcttcctgtccccccttcctctctcttctctggtttttactagggtggtagcggtcgaattagttcttccctttgctttgcatttggtgctagtggtccgtctgggctgattgttttcctctggatatgactctcgtgtgtgttgtctccagatagtgttttattgagcaatatttaaagttgtcgtcc

SEQ ID NO: 5733 - DNA, 572 bp, Artificial
  Synthetic
cccacgcgtccgatggtggcggcaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttt

SEQ ID NO: 5734 - DNA, 1105 bp, Artificial
  Synthetic
agcgacaatcagaaaccacccgctgtaaccctaggttttttcacaaacaacaaatatgactgagtcatcgcgggaagaaaatgtgtacatggccaagcttgctgagcaggccgagcgatatgaggaaatgattgagtttatggagaaggttgcaaagacaggtgatgtcgaggagctgactgttgaggaaaggaatctcctttctgtggcatacaaaaatgtgattggtgcaagaagggcctcgtggagaataatctcttcaattgagcagaaagaggagagccgtggaaatgaagatcatgtcaaaactattaaagaatacagagccaaaattgaggctgaactcagcaagatctgtgatgggattttgggtctccttgagtcccatttaataccatcagcctccacagctgagtccaaagttttttacttgaagatgaaaggtgattaccacaggtacttggctgagtttaagacaggggcagaaaggaaagaagccgcagagaacactttattaccctacaagtctgctcaggatattgctttggatgaactggctcctactcacccaatcaggctgggacttgccctcaacttttcagtgttctactatgaaattctcaactcgtcagatcgtgcttgtaaccttgcaaagcaggcctttgatgatgccatcgccgagctggatacattgggtgaggaatcttacaaggacagtacattgattatgcagcttctccgagacaatcttacactttggacttctgataccacggatgatgccggggatgagatcaaggaagcttcaaaatgcgaattaggcgaaggagagcagtaacggcataacatcatagtcttttactctttattttgtttgattttaatataggactactgcgtgaaagctagactggatatggatataattcgatgattcctcgtattactgctgaagtagtttgatataaaaacatgttttagtacgataagaaatatagtcatgccgttgatgtattggcttgtatttctagtttcaattgcatatgttattgactgttgagctttgtattttcaagtcattcaataattcaatagttcccaaaaa

SEQ ID NO: 5735 - DNA, 664 bp, Artificial
  Synthetic
gtcaggagctgagaggaaggaagcagctgagaacactcttgtggcatacaagtctgcccaggatattgcactcgctgacctgcctacaactcacccaataaggcttggacttgcactgaacttctcagtgttctactatgagatcctgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcc

SEQ ID NO: 5736 - DNA, 458 bp, Artificial
  Synthetic
tgctgtccgtggcgtacaagaacgtcatcggcgcgcgcagggcgtcgtggcgcatcgtgtcctccatcgagcagaaggaggaaggccgcggcgccgcgggccacgccgccgccgcgcgctcctaccgcgcccgcgtcgaggccgagctctccaacatctgcgcggggatactccgcctcctcgacgagcgcctcgtccccgccgccgccgccgtcgacgccaaggtcttctacctcaagatgaagggcgactaccaccgctacctcgccgagttcaagaccggagccgagcgcaaggacgccgccgacgccaccctcgccggctaccaggccgcgcaggacatagccatgaaggagctgtcgccgacgcaccccatcagactgggccttgcgctcaacttctccgtgttctactacgagatcctcaactcgcccgaccgcgcgtgcacgctcgccaag

SEQ ID NO: 5737 - DNA, 550 bp, Artificial
  Synthetic
ccccctggaggatcatctcttctatggagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtga

SEQ ID NO: 5738 - DNA, 801 bp, Artificial; identical to SEQ ID NO: 4924
  Synthetic

SEQ ID NO: 5739 - DNA, 713 bp, Artificial
  Synthetic
gtcatcacacaagtgaagaagcagtagcagtagaaggagatagaagggaacctctctctctctctctctctctttgctgatgatgaagacgactatggctgttttcgcccttctctctctcttccttcttctcctccccccttttccttcatcagctgatgatccttgtgtatactcaatctatgtacgaacggggtcaatattcaaggggggaacggattcgaagatgagtgtggagctctacgatgcgaatgggtactacattacgatcaacaatttggaggagtggggggggttaatgggtccagaccacgactactatgagaggggcaatcttgacatctttagtggtttgggggactgcctgaccggacccatctgcgctctcaacctcacctcggacggcacgggggcccaccatgggtggtattgcaactacctggaagttactgccacgggtgcccacatcccttgctcccaacagctctttaccatagagcaatggcttgccactgatacctctccttactccctcactgcccttcgatataattgccctgatgctttgtcctcgcctcgcttccctcgcatgccttccaattcgcaaccgaagaatggtcaactaatgtcccattagtactctatcaccctgcttcgtaataaaaagatagccccttcttgtgtactatggagggaggggggtatctctctca

SEQ ID NO: 5740 - DNA, 648 bp, Artificial; identical to SEQ ID NO: 4934
  Synthetic

SEQ ID NO: 5741 - DNA, 417 bp, Artificial
  Synthetic
tggtatcaacgcaaagtggccttacggccggggaaagataaagagagtaacagagaaagctcaagagaagacatgggaatagcagctcacttcaaccatttctggttccttctcttcatcctcttcttctctttctccatctccttcatttccgcatccgatgatgattgcgtgtacacagcttatgtccgaacgagttcaataataaagggtggaacagattcgattatcagtttgagtctctacgatgcaaacgggtatggtattagaatcaagaaccttgaggcctggggtgggcttatgggtcctggttacaactatttcgagaggggaaatttggacattttcagtggacgaggcccatgtttgactgagccagtctgcaaaatgaatttgacttccgacggaacaggcaaa

SEQ ID NO: 5742 - DNA, 692 bp, Artificial
  Synthetic
gagaggaagaaaaagctcaagagaagacatgggaatagcagctcactccaaccatttctggtcccttctcttcatagtctttttctctttctccatctcctccatttccggatctgatgatgattgcgtgtacacagcttacgtccgaacgagttcaataataaagggtggaacagattcgattatcagtttgactctctacgatgcaaacgggtatggtcttagaatcaagaaccttgaggcctggggtgggcttatgggtcctggttacaactatttcgagaggggaaatttggacattttcagcggacgaggcccatgtttgactgggcctgtctgcaagatgaacctcacttccgacggaacaggcaaaggccatggatggtactgtaactacgtggaggtcaccgtcaccggagtccataaagcatgcaaccaacagaatttcgaagtggagcagtggctcgctactgatgcgccgccttatgagcttacggctgttagagacaactgtaagaagtccaagtccgatgagaaactgtccatttccgatgtctacggaactcatcccactccacatgtttctgtgatttaagtttctagttattgggctttaatgggcctgggccaacatttccctgttttacaatgacatttggtgtgtgccaatgttgctttcatgtttatagtat

SEQ ID NO: 5743 - DNA, 374 bp, Artificial; identical to SEQ ID NO: 4930
  Synthetic

SEQ ID NO: 5744 - DNA, 737 bp, Artificial
  Synthetic
ggcgagccctagaggaatgcgccatggcgggcgtgcgggtggtcggggtggtgggcgcggggcagatgggatctggaatcgcgcagctcgcggcgacagcgcagatcgcggtggtgatggccgattccgacgccgcggcgctgacgaggggcttgcagagcatcgcgtcgtcgctggcgaggttcgtgaagaagggcggcatcagtgaggaagaagcaaatgcgacgcttgctcgtgtgtcgacgaccacgtccctggcggacatgagctctgcggatgtagtgatcgaggcggtgtccgagagagaaatcgtcaagaaagggatcttctcggagctggataggctgcttaaaccgtccgccatccttgcgtcgaacaccagctccatatcgatcacaaggctggcggcttccacgcagcgccctcagcaagtaattggcatgcatttcatgaatccaccaccagtgatgaaactcgtagagatcgtccgggggatggcaaccacggatgaagttttcgagcagacaaaggagctcgcggagagattcggcaagacagtggtgagctcccgagacttcccgggcttcgtggtcaaccggatcctgatgccgatgatcaacgaggcattctacgcgctgctcgagggcgtgagcagcgcagaggagatcgacacgggcatgaagctggggacgaaccagcccatggggccgctggcgctggccgactttatcggggct

SEQ ID NO: 5745 - DNA, 586 bp, Artificial
  Synthetic
  misc_feature (225)..(225): The residue at this position can be any nucleotide.
ccccccccccatcgacgtcgcctcctctcgtcctcctcctcgtcgctgcattccggttgagtgagttggtgattatctgtagggggtgaaaatggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcanggtgatggccgtgagcacggagaccaccggggtggtgacgcggatggagcagctgctcaacatggacaccacccccttcaccgacaagatcatcgccgagtacatctgggttggaggaactggaattgacctcagaagcaaatcaaggacaatatcaaaaccagtggaggacccctcggagctaccaaaatggaactacgatggatcaagcacagggcaagctccaggagaagatagtgaagtcatcttatacccacaggctatattcaaggacccattttgaggtggcaacaacatattggttatgtgtgatacctacacaccaactggggaaccccatccctactaacaaacgtaaaca

SEQ ID NO: 5746 - DNA, 809 bp, Artificial
  Synthetic
cggacgcgtgggcaaatggagaggtcatgcctggtcagtgggagtaccaggttggacctagtgtcggtattgaagctggagaccacatatggatttcaagatatattcttgagagaataacggagcaggctggtgtagtgcttacccttgaccccaaaccaattcagggagactggaatggagctgggtgccacacaaactacagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatggggtgtggcaaaccgtggatgctctattcgggtggggagagacaccgaggcgaagggaaaaggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttt

SEQ ID NO: 5747 - DNA, 649 bp, Artificial
  Synthetic
ggtctcgagcaggagtacactttcctcgaccacgatgacaggccctatggctggcccgttggcggtttccctgctcctcagggtccctactactgcggtgtaggtagcggcaaggtcgtcctccgtgacgtcgtcgaggcccactacaaggcctgtctgtatgctggcatcaacatctccggtaccaacgccgaggttctctcaagtcagtgggagttccaggtcggcccttgcgtcggcatcaacatgggtgacgagctctggatcgcccgtttcttccttgcccgcatcgccgaggactttggcgtcaagatctccctgcaccccaagcccatcaagggtggcatgaagtacatcgaggaggccctcaaggccctcgagccccaccacgccgagtgtatcaaggagtacggtgaggacaacgatctccgtctcaccggtgactgcgagactggctccatcgagaagttcagctggggtgttgccaaccgtggcacatccatccgtgttcctcgcgagactgctgcccgtggctgcggttacttcgaggatcgccggcctgcctccaacgctgacccttaccgtgtcaccaagatcctgatgacttcaattttcggcaaggcctaagtcttctttgtggatggttgtg

SEQ ID NO: 5748 - DNA, 1235 bp, Artificial
  Synthetic
gcattgcattccatttgattgcttcattttcagtccatttgttggtcttttctgaaatacccatataccggtgtacacccgtatatatacagctggttgaactgcactccgctcgcattcaatcttccccactacatcatcacatttcttctttctcccacaaacaacatcacacacaaccgtcatcatggccaaccgagaaattctgtcgtctcgaaccgagactctcaacaagtacctgaagctcgaccagaagggcaagatcatggccgagtatgtctggatcgattctaccggcgagactcgatcaaaatccaggacgctccctgagctcaaggacaaggaatacacccccgaggatctgcccgtctggaactttgacggctcttcaactggccaggctcctggtcacgattccgatgtctacctgcgccctgccgccgtctaccccgatcctttccgtggctctcccaacatcatcgtcctcgccgagtgctggaacgccgacggcactcccaacaagtacaactaccgccatgagtgcgccaaggtcatggaggccaacgctgctctcgagccctggttcggtctcgagcaggagtacactttcctcgaccacgatgacaggccctatggctggcccgttggcggtttccctgctcctcagggtccctactactgcggtgtaggtagcggcaaggtcgtcctccgtgacgtcgtcgaggcccactacaaggcctgtctgtatgctggcatcaacatctccggtaccaacgccgaggttctctcaagtcagtgggagttccaggtcggcccttgcgtcggcatcaacatgggtgacgagctctggatcgcccgtttcttccttgcccgcatcgccgaggactttggcgtcaagatctccctgcaccccaagcccatcaagggtgcttggaacggcagcggtctgcactccaacttctccaccaaccagatgcgtgaggagggtggcatgaagtacatcgaggaggccctcaaggccctcgagccccaccacgccgagtgtatcaaggagtacggtgaggacaacgatctccgtctcaccggtgactgcgagactggctccatcgagaagttcagctggggtgttgccaaccgtggcacatccatccgtgttcctcgcgagactgctgcccgtggctgcggttacttcgaggatcgccgccctgcctccaacgctgacccttaccgtgtca

SEQ ID NO: 5749 - DNA, 1090 bp, Artificial
  Synthetic
gcgtttgcgctattatagtcagtgtcgccaaagtttgtgcgatctctcctcctcaggcgccggaacaatgtcgaacctcaacgatttgctcaacctcgacatcactgacaccaaagagatcatcgccgagtacatatggattggggggtcgggtatggacctccggagcaagggccggactctgaagggcccaattaccgatccctagaagctcccgaaatggaactatgatggttccagcactggacaggctcctggcgaggatagcgaggtcatactatatccgcaggcaattttcagggatccgttcaggaaaggagacaacatattggttatctgcgacacttacactccaaagggagagccactcccctcgaacaagcgagccaaagccgaggcgattttcagtcagaaggcagtgagtgacgaagttccctggtatggaatcgagcaagagtatacattgctccagcgggaggtcaagtggcctctgggatggccgattggtggctatcccggcccccagggaccgtactattgcggaactggagccgagaaagcttgggggagagatattgtgaatgctcactacaaagcatgcatctatgccggcgtccagatcagtggtatcaacggcgaagtcatgccaggccagtgggaataccaagtcggtcctgctgttggaatttccgctggtgaccagctctgggtatcgagatatctgttggagcgaatcaccgagattgctggagtcgttctctccttcgatccgaagcccatcgaggagggtgattggaatggcgctggatgccacacaaactacagtacaaagagcatgagggaagaaggtggctacgagatcatcaagaaggccattagcaagctcggcttgagacacaaggaacacattgctgcttacggagaaggaaacgagcggcgactgactggaaagcacgagactgccaatattcatacgttttcttggggtgttgccaaccgtggagcatccgttcgtgttggccgcgacaccgaaaaggcaggaaaaggctactttgaggaccgtcgtccagcatcaaacatggacccctac

SEQ ID NO: 5750 - DNA, 1317 bp, Artificial
  Synthetic
tatctctttaattgatcagagaattgttaggcttctattttcattatgtctctgctttcagatcttatcaacctcaatctctctgattctaccaagaaaatcatcgctgaatacatatggatcggtggatcaggcatggacataaggagcaaggccaggactcttgatggtcctgttactgatccttcagaactacccaaatggaactatgatggatctagcacaggtcaagctcccggagaagatagtgaagtgatcttatacccacaagctatctttaaggatccattcagaagaggcaacaatatcttggtcatgtgtgatgcgtatactccttctggtgagcctatcccaacaaacaagaggcatgctgctgccaagatcttcagcaaccctgatgttgttgctgaggaaccatggtatggtattgagcaagaatacaccttgttgcaaagggatattaactggcctctgggctggcctattggaggcttccctggacctcagggaccatactactgtggaaccggagctgataaggcctttggacgtgatattgtggactcccattacaaggcttgtctttatgctgggattaacatcagtggtatcaatggagaagtcatgcccggacagtgggaattccaagttggaccttctgttggcatttcagccggtgatgaagtgtgggtagctcgttacattcttgagaggattacagagattgctggagtggttgtgtcatttgaccccaagcccattccgggcgattggaatggtgcaggtgctcacacaaactacagcaccaagtcgatgagggaagatggaggctatgaagtcattttgaaggctattgagaagcttggcctgaagcacaaagagcacattgctgcatatggtgaaggcaatgagcgtcgtctcactggaaagcacgaaacagccaacatcagcactttcaaatggggggttgcaaaccgcggtgcatctgtccgtgtaggacgggacacagagaaggcgggcaagggatactttgaggacagaaggccagcttcaaatatggacccatacgtcgttactgccatgatcgcagacaccacgatcatcgggaaaccttgaagctttttagtatgaattgcttgtttctggtttgcacaatttgggatagaaaaggattgatttatgaaacagccctttcgcttcgcctgtgtctttagttagggtagtttggtcttttggtatttttcttttattccagttgaagttgtattttcatacagcaaggctgatttcattgcctatgatttggcaatggtatta

SEQ ID NO: 5751 - DNA, 187 bp, Artificial
  Synthetic
atctctttaatttatcagaaaattgttagacttctattttcattatgtctcttctttcagatcttatcaacctcaatctctctgattctaccgataaaatcatcgctgaatacatatggattggtggatcgggcatggacctaaggagcaaggccaggactctttctggtcctgttactgatccttc

SEQ ID NO: 5752 - DNA, 181 bp, Artificial
  Synthetic
gaattcagaggaggcaccatatacaaatcttgagcggttcttagagcctctcgagcttagctacagatccatttgctcttgtggtgatcgagcaattgctgatcgcagccttcttgatttcttacagaaagaattctactttaggtctctcactcgtgagacttgatattaggcaaaaatc

SEQ ID NO: 5753 - DNA, 822 bp, Artificial
  Synthetic
gaggaacgccgtcaggactggctcttgtctgaactcaacgggaagcgcccgttgtttggcccagaccttcccaagaccgacgagattgctgacgttctcgacacgttccgtgtgatagctgagcttcccgctgacaattttggggcctatatcatttccatggcgacagctccgtcagacgtgcttgctgttgagctcctccaacgtgaatgccatgtgaagacgccacttagagttgtcccgctgtttgagaagttggctgatcttgaatctgccccagcagcagtggccagactgttctctatagattggtacagagaaaggataaatggcaaacaggaggtcatgattggctattcggactcgggtaaggacgccggtcgtctctcagcagcttggcagctgtacaagtctcaggaggagctcatcaacgttgccaaggagtttggggtgaagttgacaatgttccatgggcgcggtgggactgtcggaagaggcggaggtcccactcatcttgccatcttgtctcagccaccagacacgatccatggatctctccgggtcactgtccagggtgaagtcattgagcagtcctttggtgaggagcacctttgcttcaggacactgcagcgtttcacggctgccactctggagcatggcatgcatccaccaattgcgccgaaaccagaatggcgtgctctgcttgatgagatggctgtggtggccacaaaggaataccggtccatcgtcttccaggaaccacgctttggcgagtatttccgccttgcaacaccagagatggagtatggaaggatgaacata

SEQ ID NO: 5754 - DNA, 595 bp, Artificial
  Synthetic
gctccgaggtcgtgccaacgagttgcaccggaagtcctcaaggaagtacgccaaatactaggtggagttttggaagaagatttctccgggagaaccttaccgcattatactcggcgatgtgagggacaagctgtacaacacctgcgagcgtgctcgccagatcttgtcgaagggaatttctagcattcctgaagaccagacttacaccaatgtcgagcagttcttggagccgcttgagctgtgctaccgatcgctgtgcgactgcggcgacaagctgatcgccgacggcagcctgctcgagttaatgcggcaggtctccaccttcggcctctccctcgtcaagctcgacatccggcaggagtcggagcgccacaccgacgccatggacgcgatcaccacgcacctcggcatcggctcctaccgggagtggcccgaggagcggcgccaggagtggctcgtctccgagctccgcgggaggcgcccgctcttcggccccgacctgccgcagtccgaggaggtcgccgacgtgctcggcgcgttccgggtcatcgccgagctccccgccgacagcttcggcgcgtacattatctccatg

SEQ ID NO: 5755 - DNA, 635 bp, Artificial; identical to SEQ ID NO: 4936
  Synthetic

SEQ ID NO: 5756 - DNA, 516 bp, Artificial; identical to SEQ ID NO: 4935
  Synthetic

SEQ ID NO: 5757 - DNA, 574 bp, Artificial; identical to SEQ ID NO: 4940
  Synthetic

SEQ ID NO: 5758 - DNA, 190 bp, Artificial
  Synthetic
tcgaccagttcagggaggtgggccgcgtcatggcgcttgaggaggtggacttcccactactcgagtctgaggcgctcttcattcgcagggccggagaggagatcacgcaacagctttatgacttcgaggataaaggagggcgccgtgtagttctgacgcctgaaatcaccccttccttggcacgcctagt

SEQ ID NO: 5759 - DNA, 1176 bp, Artificial
  Synthetic
aaattaatattttttgtcaaaccaactatgccacacaaaatagaaaggcaaaattaagatgacaagaaagctaagcaccaactgagcagccaacgctctatttccacactttggtttctcctctctcatttctcgttttctccgcacttttcacttattaaaccattgattatataattcaacacatttcatctgtttgttagacacagcaattccattttttgatttttcctgtaattccttcatctgtgtctccaaaaacatggcgacggctttttctgcaacaaaagttttgcaacctttgccctttaattctactagatctgctgaaaacccccttttgatccaaagttcatcttttcttggatcatcattttctcataagctttctctcaagaagccttttttgcctcctaattcccagcgtcgatccaatgcagcggttgttgctgtttctgatgttgttaaggaaaagaagtctaagtccaaatcgtctctctccaatctgttgattactaaagaggaagggttggtactgtatgaggacatggtgctgggaagagcttttgaggacatgtgcgcccaaatgtattacaggggcaaaatgtttggttttgtgcatttgtacaacggccaagaagctgtctcgactggtttcattaagctcttgaagaaggaagactctgtagttagcacttaccgtgaccatgtccatgcattgagtaaaggtgtcccagctcgtcaagtgatgagtgagctatttggaaagaccacgggctgttgtagaggccagggtggatccatgcacatgttctccaaagagcacaatgttcttggtggtttcgcttttatcggtgagggaatcccggtggctgcaggtgctgcattcactagcaagtacagaagggaggtcttgaaggaggctgattgtgatcatgtcactctagccttctttggtgatggaacttgcaacaatggccaattctacgagtgcttgaacatggccgcattgtggaaattgcccattatctttgttgttgagaacaatctgtgggcaattgggatgtctcacttgaggtctacttctgatcctgaaatttggaagaaaggtcctgcttttgggatgcctggggttcatgttgatggcatggatgtgttaaaggtgagggaggtagc

SEQ ID NO: 5760 - DNA, 957 bp, Artificial
  Synthetic
acgcgtcgagagaagaagaacagctaggaagagctcctcgtctctccatggcgtcgcgagctatggcgtcgatcagcccatcgtccatctccgccggcgcctgccgcgacgacgtcggatcttccagtgtagtaggcttccataatagaagcggcaacagcagcgcattcaccggccgcggcatccgggtctcgaccagatcgctgtccaccgccagcgccaagaagaggagctgcgccgtcgccgccaccgccgcgccggtcaaggaatccccgccaaagatcgccgacacgctcgtcacgcgggaggaaggcctggagctctacgaggacatggttcttggtcgatccttcgaggatatgtgcgcccagatgtactaccgcagcaagatgtttggattcgtccacctctacaacggccaggaagccgtctccacgggattcatcaaggcgctcaagaaggacgactacatctgtagcacgtatcgagaccacgtccatgcgctgagcaagggcgtccccgccaggcaagtcatgagcgagctcttcgggaagtccacgggatgctgccgcggccagggcggatccatgcatatgttctccaaagagcaccgcctgctcggtggattcgccttcatcggcgaggggatccccgtcgccaccggcgcggcattcaccaccaagtactcgcgggaggttctcaaggaccagagcgttgatgcggtgacgctggccttcttcggcgatgggacgtgcaacaatgggcagtttttcgagtgcttgaacatggcggcgctgtggaagttgccgattgtgtacgttgtggagaacaatctgtgggcgattgggatggatcacttccgggcgacgtcggtgcccgacatttggaagaagggcgaggcgtttggcatgcccggggttcatgtcgatgggatggacgtgcttaaggtccgtgagg

SEQ ID NO: 5761 - DNA, 748 bp, Artificial
  Synthetic
tcgaccacgcgtcggaaggaagagcgatggcgatagcgatggctcggcggcggcttctctcctcctcctcctcctccacgtcctcggcagcggcagccgcggcgccgcttctccggcgggcggcggcgctcaatccatccaggtacttcgcgtcgtcggggatggacgacacgacgccgttcgtggtggacatccccgtgccctacgccgggcatcgatgcgaccccccggagcagaaggtggagacgtcggccaaagagctggtggactacttcaaggtgatgtacgtgatgaggcggatggagatcgccgcggacagcctctacaaggccaagtttatacgtggtttctgccacctttacgacggccaagaggccgtgtgcgtcgggatggaggcggcgctcaccaaagaggacgctatcatcaccgcgtatcgagaccactgcacgcatcttggacgtggtggaactgtgctcgaggtgatggccgagttgatggggaggaaggatggatgctcgctgggaaagggtggatcgatgcatatgtacaagaaggatgccaacttctatggagggaatgggatcgttggtgcacaaactgctctcggtgctggcctggccttcgcgcagaagtataacaagcagggcgcggtgtcgctggcgctgtatggagatggtgcggccacaccagggcagctgtttgaggcgatgaatatcgcggcgctgtgggacttgccggcgatcttcgt

SEQ ID NO: 5762 - DNA, 396 bp, Artificial
  Synthetic
gttcttggaagagcttttgaggacatgtgtgcccaaatgtattacaggggaaaaatgtttggttttgtgcatttgtacaatggccaagaagcagtctccactggcttcattaagctattgaagaaagaggactcagtggttagcacttatcgtgatcacgttcacgcattgagcaaaggggttccagcacgtcaagtgatgagcgagctctttgggaagaccactggctgttgcagaggccaaggtggttccatgcacatgttctcgaaagaacacaacgttctcggtggtttcgctttcattggtgagggtatccctgtggcgacaggtgccgccttcactagcaagtataaaagggaggtactgaaagaggctgactgcgatcacgtaactatg

SEQ ID NO: 5763 - DNA, 742 bp, Artificial
  Synthetic
cccacgcgtccgagcactgctactggacatactctactactactagccagtaagctagctaactaactacgtggctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcctaccctgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatatttttattttacagtttggttatgtaccatctcaa

SEQ ID NO: 5764 - DNA, 753 bp, Artificial
  Synthetic
cgctcttgaaagcaaaggtcaagggtagcaatagctttaagcttagaaattattttcagaaatggcttcctcagttatgtcctcagcagctgctgttgcgaccggcgccaatgctgctcaagccaacatggttgcacccttcactggcctcaagtccgcctcctccttccctgttaccaggaaacaaaaccttgacattacctccattgctagcaatggtggaagagttcaatgcatgcaggtgtggccaccaattaacatgaagaagtacgagacactctcataccttcctgatttgagccaggagcaattgcttagtgaagttgagtaccttttgaaaaatggatgggttccttgcttggaattcgagactgagcgtggattcgtctaccgtgaacaccacaactcaccaggatactacgatggcagatactggaccatgtggaagttgcccatgttcgggtgcactgatgccactcaggtgttggctgaggtcgaggaggcaaagaaggcttacccacaagcctgggttagaatcattggattcgacaacgtccgtcaagtgcaatgcatcagttttatcgcctccaagccagaaggctactaaaatctccatttttaaggcaacttatcgtatgtgttccccggagaaactgttttggttttcctgcttcattatattattcaatgtatgtttttgaattccaatcaaggttatgagaactaataatgacatttaatttgtctttggtc

SEQ ID NO: 5765 - DNA, 718 bp, Artificial
  Synthetic
aaaagagagaaagagaaatctttctgtcttaagtgtaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatctgagcgtggagcaattgcttagcgaaattgagtacctcttgaaaaatggatgggttccttgcttggaattcgagactgagcacggatttgtctaccgtgaacaccacaagtcaccgggatactatgacggcagatactggaccatgtggaagttgcctatgttcggatgcactgatgccacccaagtgttggccgaggtggaagaggcgaagaaggcatacccacaagcctggatccgtattattggattcgacaacgtgcgtcaagtgcagtgcatcagtttcattgcctacaagccagaaggctactaagtttcatattaggacaacttaccctattgtccgactttaggggcaatttgtttgaaatgttacttggcttcttttttttttaattttcccacaaaaactgtttatgtttcctactttctattcggtgtatg

SEQ ID NO: 5766 - DNA, 737 bp, Artificial; identical to SEQ ID NO: 5045
  Synthetic

SEQ ID NO: 5767 - DNA, 619 bp, Artificial; identical to SEQ ID NO: 5047
  Synthetic

SEQ ID NO: 5768 - DNA, 700 bp, Artificial
  Synthetic
cctccgagtgcatctcaagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggatttgtctaccgtgagaaccacaggtcccctggatactacgacggcaggtactggaccatgtggaagctgcccatgttcgggtgcaccgacgccacccaggtgctcaaggagctcgaggaggccaagaaggcgtaccctgatgcattcgtccgtatcatcggcttcgacaacgttaggcaggtgcagctcatcagcttcatcgcctacaagcccccgggctgcgaggagtctggtggcaactaagccgtcatcgtcatatatagcctcgtttaattgttcatctctgattcgatgatgtctcccaccttgtttcgtgtgttcccagtttgttcatcgtcttttgatttaccggc

SEQ ID NO: 5769 - DNA, 809 bp, Artificial
  Synthetic
cgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggatttgtctaccgtgagaaccacaggtcccctggatactacgacggcaggtactggaccatgtggaagctgcccatgttcgggtgcaccgacgccacccaggtgctcaaggagctcgaggaggccaagaaggcgtaccctgatgcattcgtccgtatcatcggcttcgacaacgttaggcaggtgcagcttatcagcttcatcgcctacaagcccccgggctgcgaggagtctggtggcaactaagccgtcatcgtcatatatagcctcgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatctatgaaagctccggctatatatattta

SEQ ID NO: 5770 - DNA, 842 bp, Artificial
  Synthetic
ccccagggcctcaacagcactgctactggacatactctactactactagccagtaagctagctaactaactacgtgctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatattgatgatatatcaatatataatatgctatatatttttattttacagtttggttatgtaccatctcaatggcctctgctcttaacacatatgtaataatctcttccctccctctccgaccgggtttattgtaagagtactacaattatcgttgggtgaggatatgt

SEQ ID NO: 5771 - DNA, 839 bp, Artificial
  Synthetic
ccccccccggcacctaccttaagatctaaacgtccattttcaacagcaaaacaaattcacagaaatatcaaaaaatggattctgagggtattcttttgggtatgggcaatccattgctcgatatctctgctgttatcgatcaagatttcctcaacaagtatgacattaagccaaacaatgcaattcttgctgaggaaaagcacttgtctatgtatgatgaaatgacatccaagtttaatgttgaatacattgctggaggtgcaacacaaaattcaatcagagtagctcagtggatgcttcaaattccaggtgcaacaagttacatgggctctattgggaaggacaagtatggggaggaaatgaagaaaaatgcaaaagatgctggtgtcaatgttcactattatgaggatgagagtccaacgggtacttgtgctgtctgtgtgcttgacggcgaaaggtcgctggttgcaaacttatcagctgcaaactgctacaaggttgaccatttgaaaaaaccagagaactgggcgttggtggagaaggccaagtactattacattgctggattttttctcactgtttctccagaatctattcagcttgttgctgagcatgcagctgcaaaacacaaggttttttcaatgaacctttcagcgccatttatctgtgagttcttcaaggatcaacaggagaaagtcttgccatatatggactttgtctttggcaatgagacagaagcaagaaccttctctagagtccacggttgggagactgataacgttgaagaaatagctttgaggatctcgcaatggccaaaggcatcaggaacacacaagaga

SEQ ID NO: 5772 - DNA, 260 bp, Artificial
  Synthetic
cccacgcgttcgatctgaacctcttccctttcctcgaaagggcttctaacatcatcatccatggcttcctctgatttcgatggaatccttttgggaatgggaaacccactcctcgacgtctctgccgtcgtcgaccaacagtttctcgacaaatacgacatcaaattgaacaatgcgattctcgcagaggacaaacatttgcccatgtacgatgaaatgagccagaagttcaatgttgaatacattgctggaggtgctac

SEQ ID NO: 5773 - DNA, 513 bp, Artificial
  Synthetic
cccccccccccgggggggccggctctctccctgtcccctctcccccgcctcgccgcagccgaactcctcgcgctaaaccctcgccgcggcggcggcgggggcggtgccatctcccctccatccccgtctcaccgcagccgggaacgtacgcttcgcgctttcctctcccgtcgtcgaatcgaatcgacccaagtagttgcgggacacgggcggtgagagagatgctggtgctgttcgagacgcccgcggggttcgccctcttcaaggggctcgacgaggggaagctcgacaaggtcgaggatttatggaaggagttcacgacgtctgactcggcgagaaaggtggttgagctgaaggctttcaacaagtttgagaacacatctgatgccctttctgctgcaaccctcattattgacagcaagcctaccaagggtttgcgcaagttcttgcacaagccctgggagggtgaaacattagctgtggctgactctaaacttggaaatgctataaagg

SEQ ID NO: 5774 - DNA, 695 bp, Artificial
  Synthetic
agaaagcacagcttggtctttctcacagttacagcagggcgaaagttaagtttaacgtgaatcgaatcgacaacatgattatccagagcattagtttgctcgacacaatcgacaaggacatcaacaccttcgccatgagagtcaaggagtggtactcatggcattttccggagctagtgaagattgtcaacgataactacatatacgcaaagctttgcacgtccatcaaggacaagtccaatcttaccgacgatgcgcttgacgagttgacggagataacgggcgaggaagacaaggcaaaggaaattctagcggcttccaagtcatccatgggtcaggacatttctcccgtcgacttaatcaacatccaggcgtttggagagcgggttgtacgtctggtggagttccgaaccgtgctgcatggctatctcatgtcgaagatgaatggcattgcaccgaacctggccactctcatcggagaaatcgttggtgctcgacttatctctcgtgccggaagcctcactaacctggccaagtgtcctgcttccacagttcaaattcttggagcagagaaagctctgttcagggctttgaagacgaaaagcaatacgccgaagtatggcctcatcttccattcttctttcatcggaagggcttcaacaaaaaataaaggccggattgctcgattcctggcg

SEQ ID NO: 5775 - DNA, 614 bp, Artificial; identical to SEQ ID NO: 4971
  Synthetic

SEQ ID NO: 5776 - DNA, 698 bp, Artificial; identical to SEQ ID NO: 4969
  Synthetic

SEQ ID NO: 5777 - DNA, 651 bp, Artificial; identical to SEQ ID NO: 4967
  Synthetic

SEQ ID NO: 5778 - DNA, 336 bp, Artificial; identical to SEQ ID NO: 4963
  Synthetic

SEQ ID NO: 5779 - DNA, 713 bp, Artificial; identical to SEQ ID NO: 4961
  Synthetic

SEQ ID NO: 5780 - DNA, 636 bp, Artificial; identical to SEQ ID NO: 4945
  Synthetic

SEQ ID NO: 5781 - DNA, 796 bp, Artificial
  Synthetic
tcctctctctctctctctcctctctcctctctctctgtagagctgagagaaaatcaaatcaaatcaaaccccctttgatttgacccccttttcctctagggtttctgcacaaatttccctccagaatcagtagaaaagaagatcaatcagcaatggatccggtgccatcgagcgcatctcatggaaatcttgacgaacaaattgctcagcttatgcagtgcaaacccttgtctgaacaggaggtaagagggctatgtgagaaagcaaaggagattctaatggaagagagcaacgtgcagcctgtgaaaagccctgtgactatatgtggtgatattcatggtcagttccatgatcttgctgagctttttcgaattggtggaaagtgtcctgacactaattatttgttcatgggagattatgtggatcgtggatactattctgttgaaacagtaacgcttttagtggctctcaaagtgcgatatccccagcgaattacaatcctaaggggtaatcatgagagtcgccagattactcaggtttatgggttttatgatgaatgcctgcggaaatatggtaatgccaatgtgtggaagactttcacagatctgttcgactactttcctctgactgctttggttgagtcagagattttttgcctccatggtggtctgtctccatctattgaaactcttgataatattcgcaattttgaccgtgtacaagaagttccacatgagggtgctatgtgtgatcttttatggtctgatcctgatgatcgatgtggttggggtatctc

SEQ ID NO: 5782 - DNA, 652 bp, Artificial; identical to SEQ ID NO: 4954
  Synthetic

SEQ ID NO: 5783 - DNA, 610 bp, Artificial; identical to SEQ ID NO: 4956
  Synthetic

SEQ ID NO: 5784 - DNA, 685 bp, Artificial; identical to SEQ ID NO: 4957
  Synthetic

SEQ ID NO: 5785 - DNA, 537 bp, Artificial; identical to SEQ ID NO: 4946
  Synthetic

SEQ ID NO: 5786 - DNA, 638 bp, Artificial; identical to SEQ ID NO: 4951
  Synthetic

SEQ ID NO: 5787 - DNA, 582 bp, Artificial; identical to SEQ ID NO: 4972
  Synthetic

SEQ ID NO: 5788 - DNA, 592 bp, Artificial
  Synthetic
caaaacccccccgacaccgagcccctcctcctcgacctcgccgcaaatcctccgccgctagggcataaccgcccgcctctcgccggcatccgcatctcccggggaagggaagggaagggaagggaaggaaggaaggtgagggcggatatgtcggcggcgccgataccccgcgagtgggtggggctgcagcagtttccggcggctacccagaccaagctgcacgagctcctcggcaagctcaaggaggagaatgtgagcacattgacaattctggtgatggggaagggcggggtggggaagtcatccaccgtcaactccatcgttggcgagagggtcgctactgtcagcgccttccagtccgagggtctcaggccgatgatgtgttctcgcaccagggcaggcttcaccttgaacattattgacactcctgggctcattgaaggtggatacatcaatgagcaggctgttgagatcataaaaaggtttcttctgggcaagactattgatgtcctcctttatgtggatcgattggatgcatacagaatggacacgttggatgatcaagttattagagctgtcaccaattcatttg

SEQ ID NO: 5789 - DNA, 984 bp, Artificial
  Synthetic
gccctaaaccactggagcagcagcattgcccttatcctcgcggcgaatctcttcccggtacgtgattcctcgtctagattctagcggcggcgccgcttctcgctatcgattgattgagccgccgctgctccgcgaagatgggaagcataaaggaatggtcgggcatcaaccagttccccgtcgctacacagaccgctctccacgggctgcttggcaaggtccggcaacagaatgtggatagtatgactgttcttgttctcggtaaaggaggagttgggaaaagctctaccgttaattctgtaattggtgaaagagtagcggctgtcagtgccttccagtctgaaaccttgaggccgctctgcgtttcccgatccagagctggatttactttgaacatcatcgatacaccgggtttgatcgaaggtggatgggtgaatgaccaagctctagagattatcaagaggtttctcttggacagaactattgatgtggttttgtatgtcgatcggctggacggctatcgagttgatagcctggacaagcaagtgatcaaggccattagtcgtggctttggtcctcagatctggaaaatttgtctgctcgttttgactcacgcacagcttcctccacccgacggtacaagttacgacgattatgtgcaccacaggtccgaggggcttctggcggctataaggcatgaagctggcttcaagaaaactgaccccgacattccttacgcgcttgtggaaaatagtggccgatgcagcaccaatgctggtagcgagaagatacttccggacgggacagtgtgggtgccaaatctggtcgctcgacttgtggaagtggtcaccaacgatcagccgtcgctgctggtggacaagaagcttatcgaaggtcccaacgcgaacaaccggggaaagctgtggattccgctggtgttgctcgcagagtatctcttcgtggtgagaccgatccaaagcgcaa

SEQ ID NO: 5790 - DNA, 817 bp, Artificial
  Synthetic
ataagatccatccatttagcagcaccttaggatggcatagccttaaaagtgaagggcgaggttcaaacgaggaaaggcttacggtggatacctaggcacccagagacgaggaagggcgtagtaatcgacgaaatgcttcggggagttgaaaataagcatagatccggagattcccgaatagggcaacctttcgaactgctgctgaatccatgggcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgtcgtgctgctaggcgaagcagcccgaatgctgcaccctagatggcgaaagtccagtagccgaaagcatcactagcttatgctctgacccgagtagcatggggcacgtggaatcccgtgtgaatcagcaaggaccaccttgcaaggctaaatactcctgggtgaccgatagcgaagtagtaccgtgagggaagggtgaaaagaacccccatcggggagtgaaatagaacatgaaaccgtaagctcccaagcagtgggaggagccagggctctgaccgcgtgcctgttgaagaatgagccggcgactcataggcagtggcttggttaagggaacccaccggagccgtagcgaaagcgagtcttcatagggcaattgtcactgcttatggacccgaacctgggtgatctatccatgaccaggatgaagcttgggtgaaactaagtggaggtccgaaccgactgatg

SEQ ID NO: 5791 - DNA, 614 bp, Artificial
  Synthetic
agaggaaggattgggtggtacaggcggccatggcggcagcgtccatcacgccggcttgtgcgcgatgcaatgccgctgctagcaagggcttttcggatttctccggcctcaagagcaagaatgctgtcacattcggtcgcggagccgaggatttggcgaccagagtagcttcccaaacttgcaaggtttgaattatttgattgctatggatggaagttcgttcttatgtacaagttagagagtgtagatctccagctccggtggagcaaagcgcgcggttgccgaggccaagatcaaggttgcgatcaatggatttggaagaattggccggaacttcatccgctgctggcacggaagaaaggactcgccattggacgtgattgtcatcaacgacaccggcggcgtcaagcaagcctctcacctcctcaagtatgattccatgcttggaactttcgatgcagacgtcaaggtctctggagacagcgcgatctcggtcgatggcaaggtcatccaggttgtctccaaccgagaccctctcaagttgccatggggagagcttggagtagaccttgtgatcgagggaactggagttttcgtggatcaagatggagctg

SEQ ID NO: 5792 - DNA, 679 bp, Artificial
  Synthetic
acttgtgtggagaggaaggattgggtggtagaggcggccatggcggcagcgtccatcacgccggcttgtgcgcgatgcaatgccgctgctagcaagggcttttcggatttctccggcctcaagagcaagaatgctgtcacattcggtcgcggagccgaggatttggcgaccagagtagcttcccaaacttgcaagatctccagctccggtggagcgaaacgcgcggttgccgaggccaagatcaaggttgcgatcaatggatttggaagaattggccggaacttcatccgctgctggcacgggagaaaggactcgccattggacgtgattgtcatcaacgacaccggcggcgtcaagcaagcctctcacctcctcaagtatgattccatgcttggaactttcgatgcagacgtcaaggtctctggagacagcgccatctcggtcgatggcaaggtcatccaggttgtctccaaccgagatcctctcaagttgccatggggagagcttggagtagaccttgtgatcgagggaactggagttttcgtagatcaagatggagctgggaagcacttgaaagccggtgccaagaaggtgttgatcacagcccctggaaagggtgccattccaacttacgtcattggagtgaacgccgagcaatacagccccagcgagccgatca

SEQ ID NO: 5793 - DNA, 662 bp, Artificial
  Synthetic
tatcactactcatctcagtcggtctgtcattattactcgaccacgcgtcgtatcgactagttcatgtatcgaatccaatcactgattccatggcgaccgcttctctctcctcctcttccaagcctgtctctttctctcaggtttctgggaaaggccttccagactactccggcttcaagagttccacctgcatcagctttcgacggagaaatgacgacttcctctctcagacgtcgcttttcatagcttcagcttcgagctctggtgcaaagaggggggttacagaggcgaagatcaaagtagccatcaatggatttggaagaatcggacggaacttccttcgatgttggcatggaaggaaggactcccctctggagattgtaatcataaatgatactggaggtgtgaagcaagcctctcacctactcaagtatgactcgatgctcggaacctttgacgctgacatccaaatcgttggtgatgacagcatttctgttgatggcaaggtcatcaagattgtgtccaccaggaacccgttaaaccttccatggaaggcctatggagttgacctagtgattgaaggaacgggagtctttgtggaccaggaaggggcagggaaacatatcacggcaggagcgaagaaggtgctcatcacggcgcct

SEQ ID NO: 5794 - DNA, 557 bp, Artificial
  Synthetic
ggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagtgatctctga

SEQ ID NO: 5795 - DNA, 1047 bp, Artificial
  Synthetic
cgagcatacaggcggcagcgacaagccatggccacacacgcagcgctcgcggcgtcccgcattcgtggcaccgcccggctgcacaacaaggcggcgtccaaacagagggtggacttcgccgacttctccggactgaggccgggatcgtgctccatcagccacgccgcgagggaggcgtccttctccgatgtccttggctcgcagctcgtcgccagggctaccggagagaacgccgtgagggcgccggctgaggcgaagctcaaggttgccatcaacggcttcggccgcattggccgcaacttcctccggtgctggcacgaacgcgagaactccccgctcgaggtcgtcgtcgtcaacgacagcggaggcgtcaggaacgcatcacaccttctcaagtacgactcgatgctcggcaccttcaaggccgacgtcaagatcgtcgacgaccagaccatcagcgtcgacggcaagctgatcaaggtcgtctccaacagggaccccctcaagctgccatgggctgagctcggcatcgacattgtcatcgagggtaccggagtgttcgtcgacggccccggcgccgggaagcacatccaggccggcgcgaagaaggtcatcatcactgctccggcgaagggtgctgacatccctacctacgtcctcggtgtcaacgagggagactactcccacgaagtggccaacattatcagcaatgcttcctgcacaaccaactgcctcgctccgttcgtcaagatcttggacgaagagttcggaatcgtaaagggaaccatgaccacaactcactcctacaccggcgaccagaggttgctggacgcgtcgcaccgtgacctgaggagggcccgggcggcggcgctgaacatcgtgccgacgagcaccggcgccgcgaaggccgtggcgctggtgctcccgcagctgaaggggaagctcaacggcatcgcgctgcgcgtgccgaccccgaacgtgtccgtggtggacctggtgatcaacaccgtgaagaccggcatcaccgccgacgacgtgaacgccgcg

SEQ ID NO: 5796 - DNA, 266 bp, Artificial
  Synthetic
cggacgcgtggggaaaggcttgcggtggatacctaggtacccagagacgaggaagggcgtagcaagcgacgaaatgcttcggggagttgcgttgttttctgcagtagtatcccaggtaacggtagaagaagtaaatttgttgtatcatatgacatctttgggtatatgtgatgattgatggagttcattacgacgtgatccttgaccatgtatttagtgaattcttgccagttcgatattatggataaagttagtgttttcgtttt

SEQ ID NO: 5797 - DNA, 488 bp, Artificial
  Synthetic
gaattcagggcttacggtggatacctaggcacccagagacgaggaagggcgtaccaagcgacgaaatgcttcggggagttgaaaataagcatagatccggagattcccgaataggtcaacctttcgaactgctgctgaatcctaacacggggaggtagtgacaataaataacaataccgggctcttcgagtctggtaattggaatgagtacaatctaaatcccttaacgaggatccattggagggcaagtctggtgccagcagccgcggtaattccagctccaatagcgtatatttaagttgtcgcagttaaaaagctcgtagttggactttgggttgggtcgtccggtccgccctttgggtgtgcaccggtcgtctcgtcccttctaccggcgatgcgttcctatccttaattggccgggtcgtgcctccggtgctgttactttgaagaaattagagtgctcaaagcaagcccaagctctggataca

SEQ ID NO: 5798 - DNA, 587 bp, Artificial
  Synthetic
gcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagtgatctctgaccgcgtgcctgttgaagaatgagccggcgactcat

SEQ ID NO: 5799 - DNA, 696 bp, Artificial
  Synthetic
gaattcagaagaagacacaaactagaccattgcctctcttttttcaggtggacctagaaaaaaaactctcattttcttgatccaatcaaacaatcaataatcctagaataacaaggaattatttagagaagatagattgatagagatgtcgtgttcatcatcatctggttcagaggatgaagatgagggagttgatgcttacaggaaaggaggatatcatgctgttcggattggagatccattcaatggtggtcgatatattgctcaaaggaaactcggttggggaaatttctctactgtttggcttgcttatgacactaaatcatctaaatttgttgcacttaaaatccaaaagagtgctgctgaatttgccgaggctgcacttcacgagattcaagttttatctgccattgctaatgggaatccgtcggattcaaaatgtgttattcgtttgatcgatcaatttaagcactcaggtccaaatgggcagcatttatgtatggttttggaatttcttggcgacagcttgcttcgtctaataaagcataaccgttataaaggtcttccattgaataaagttcgagaattgtgcaaatcgattctgatgggtcttgattacttacatagagaactcggtataattcatacagatttgaaacctgaaaatgtgcttcttgtatccactattgatccttc

SEQ ID NO: 5800 - DNA, 665 bp, Artificial
  Synthetic
ggagagaatatggtaatgaaggccacatataccccctcattaacgcactgtccctttcattcttaaagctttttccacgagaattccactttgcttcttctctaatcgaaaatcatcaaatttataatcaatcaaatcaaacgataaacatatttaataaatttgtagatcacacacagtgtgtgtaaatccggtttgatccattcaccgatcatgtcatgttcaccgtcgtcatcgtcggcatcggaagatgaagatgaaggaatggattcatacagaaaaggaggatatcatgccgtgaggatcggcgattcattctccggcggccgatatatcgctcagcgaaaactcggctggggtgaattctccaccgtttggctcgcttacgatacgcgatcgtccggatttgtagccttgaagatccagaaaagtgcgccacaatttgctcaagctgctcttcacgaaattgaaatcctttctgctattgctgacggtgatccctctaatagtaaatatgttgtcagacttattgaccattttaagcatataggtccaaatggacagcatttatgcatggtccttgaatttcttggtgacagcttattgcacctcgtcaaatataatcgttataaaggccttgaactgaacaaagttagggaaatatg

SEQ ID NO: 5801 - DNA, 370 bp, Artificial
  Synthetic
tccgattatgatcaagcctgacggcgtccagagaggactcatcggtgaagtcatctgcaggtttgagaagaagggtttcacgttgaaaggtctgaagttgatcagtgtagagagatcttttgctgagaagcactacgaagacttatcttcaaagtctttcttcagtggactcgttgactacattgtatccggccctgttgttgctatgatctgggaaggaaagaatgttgtcttgaccggaagaaagatcattggagctaccaacccagcagcttctgagcctggaactatccgtggggactttgctattgacattggcaggaacgtgatccatggtagtgactctgtcgagagtgcaagaaaggacatt

SEQ ID NO: 5802 - DNA, 572 bp, Artificial
  Synthetic
aattgaacaatataaattcaaatactagtcatcccatacttattgcttatgctctgattactgagttcaccggggaaaaatcaaaacccggaatgtgtttgtatccgtaacaactgtttcttgtttttattgtatgggtaaaaaaagaaaagaaaaaccaatgtgatttgatttcaaaagacaagaggaagagggatttagttgtcaccataaagccacttctcaaagttactagtgtaaaaaacaagttcttgaggcttaaaccacagactgatctcatcctttgcagtctctggtccatcacttccatggattatgttcctgccaacagtaactgcaaaatctcctcggattgttccaggctcaaatttctgaggatcagtggctccaatcagtttacgtccgtatctgatcacaccatctccttcccaaaccatggcaataacaggaccagagctaaggaagtcacacaaaccattgaaaaaaggtctttccttaaaatcatggtaatgcttttgtgcgaaatctttagaaggaacaatgactttgataccaactagcttgaatccctt

SEQ ID NO: 5803 - DNA, 719 bp, Artificial
  Synthetic
tggtatcaacgcagagtggccattacggccgggggctgcgactgctattctaaatccgtaggaccatttttcagaacatcaaagaagcgaaaatggagcagactttcatcatgatcaagcctgatggtgtccaacgtggcctggttggtgagattatcggaagatttgagaagaaaggattctctttgaaaggcttgaagctcatcactgtggatcgtgcctttgctgaaaagcattacgcagacttgtctgctaagcctttctttagtggtcttgttgattatattatctctggccccgttgttgcaatggtctgggaaggtaagtgtgtagttaccactggcaggaagatcattggagcaacaaacccattggagtctgctcctggtacaatccgtggtgattatgctattgacattggcaggaacgttattcatggaagtgatgcagtcgagagtgcaaggaaggaaattgctctttggttccccgaaggagttgcagagtggcagagcagccttcactcttggatctatgagtagaaatgttttgtttactttagaactctattaatggcctgcctgtttgggtgtaacttatgaattttggatgtgatttgagtctagaagtttattgtttgaggttttctgttattccctatttcaagaatatttaatgtgatcagtattactttcgtgatatttatagtcctttttgtgctt

SEQ ID NO: 5804 - DNA, 315 bp, Artificial
  Synthetic
tggtatcaacgcaggtggcattacggccgggggtgctgcgactgctattctaaatccgtaggaccatttttcagaacatcaaagaagcgaaaatggagcagactttcatcatgatcaagcctgatggtgtccaacgtggcctggttggtgagattatcggaagatttgagaagaaaggattctctttgaaaggcttgaagctcatcactgtggatcgtgccttcgctgaaaagcattacgcagacttgtctgctaagcctttctttagtggtcttgttgattatattatctctggccccgttgttgcaatggtct

SEQ ID NO: 5805 - DNA, 959 bp, Artificial
  Synthetic
cggacgcgtggggacttttctctctttttcttgtaaaagtctaagagatgaattctcagatttacagatctgcttcacgagctgctaagtctctcgtttctgcctccaaacagagttctcgtgctttttctggggggcgagcagcagctgcagcagccacagtttctttgagaggagtggtgccttctctagcctcatatggcaggacagattctggaaacgcatctagagcttggatttctggtgtccttgcccttcctgcagcagcttacatgctccaagagcaagaagcacatgctgctcagatggagcgcacctttattgccatcaagccagatggagtgcagaggggcctgatttcagaaatcatagcacgctttgagcgcaagggtttcaagctggttgcaatcaaaattgtgattccttccaaggaattcgcacagaagcactatcatgacttgtcggagagaccattctttaatggcctatgtgatttccttagctctggccctgtcctagctatggtttgggaaggtgaaggagtaatcagatatggaaggaagcttatcggagccacagatccacagaaatccgaaccaggaaccatcagaggtgacttagctgttgtagtcggaaggaacatcatccatggtagcgatggaccagagactgccaaggatgagatcaacctatggtttaaaccagaagagttggttaactacacaagcaattcagagaggtgggtatatggtgacaactgagcgaacctattctaccttaatctgaattgccattaaatcggcatgaagagtagcatactcataatttatcacgaataaatcggatgccatttttccttaggctggtagcaactttacctctaccatactgaacctcatttttcttggattttttctttctgttaccagaggaaagatcagttggccctaaaaaaaaag

SEQ ID NO: 5806 - DNA, 538 bp, Artificial
  Synthetic
  misc_feature (429)..(429): The residue at this position can be any nucleotide.
gaattcaaatctatgtcgttcaagagctttggaagcattccgatgtgatccagcgaaatggggtgtgaatgtacagccttactctggtagtcctgctaattttgcagcgtatactgctttgttgaatccacatgatagaattatgggtcttgatttgccatcaggtggtcatttgacacatggttattatacatctggtggtaagaagatttctgctacttcaatttactttgagagtttgccttataaggtgaattctactactgggtatattgattatgataagttggaagagaaagctttggatttcagacctaaattgattatctgtggtggtagtgcttatcctagagattgggattatgctagatttagagctgttgctgataaatgtggtgctcttttgctttgtgacatggctcacattantggtcttgttgctgctcaggaagctgccaacccatttgaatactgtgacgttgtcacaaccacaactcacaagagtttgaggggacctagggctggtatgatcttcttc

SEQ ID NO: 5807 - DNA, 466 bp, Artificial
  Synthetic
atatttgcaattattgagaaagagaagagtaggcagttcaggggcctggaacttattgcctctgaaaacttcacatctcgagctgtaatggaagcagtcggttcttgcctgacaaacaagtattctgagggactacctgggaaaagatattatggtgggaatgaatatatagatgaaagtgagcgattatgtcagcaaagagccttagctgcttttcatcttgacccaaagttgtggggggtgaatgtacaaccactgtctggctccccagccaattttgctgtctacacagccttgctccgacctcatgacagaataatgggccttgaccttcctcacggtgggcatttatcccatggttttatgacaccgaagagacgagtatcggctacttccatttactttgaaatccatgccatatcgtctggacgaggcaaaaggtaagatcgactatgaaatgatggag

SEQ ID NO: 5808 - DNA, 1203 bp, Artificial; identical to SEQ ID NO: 4991
  Synthetic

SEQ ID NO: 5809 - DNA, 676 bp, Artificial; identical to SEQ ID NO: 4994
  Synthetic
  misc_feature (610)..(610): The residue at this position can be any nucleotide.

SEQ ID NO: 5810 - DNA, 657 bp, Artificial; identical to SEQ ID NO: 5003
  Synthetic

SEQ ID NO: 5811 - DNA, 832 bp, Artificial
  Synthetic
caaaatcagttttgctcaatacccttttcaagattcactcaaagttcaaaactttcattgaaaaaatcaagaatggttgttgtttcagctacaactgctgctgagaaatccaataaaaggtatcctggtgaagctaaagggtttgttgaggagatgagatttgtggctatgaaattgcatactaaggatcaatctaaggaaggtgaaaaagaacctgaaggtcagcctatggctaaatgggaacctagtgttgaagggtatttgaagtttttggtggatagtaaattggtttatgatactttggaaaagattatggaaaaggctcctttttctgagtatgctgagttcaggaacacgggattagaaaggtcagaggccttagcaaaagatttggaatggtttaggctgcaaggttatgccatcccagaaccatcagctcctggtctcaactatgctcgttacctagaggagctatcagaaaaggatcctcaagcatttatttgccacttttacaacacatactttgcgcattcagctggtggtcgcatgatagggagaaaggtggctgaaaagatactcaataagaaagagctggaattctacaaatgggacggtgacctttctcagctgctgcagaatgttagagagaagctgaataaagttgcagaaaattggactagagaggagaagaatcattgtttggaagagacggagaagtcattcaagttctcaggggaaatcctccgattaatattgtcttgatgcgcggctttgcatttgtacgttggatggcctaaagctcaaattactgtgaatagtcgtgttcattttc

SEQ ID NO: 5812 - DNA, 1478 bp, Artificial
  Synthetic
aggacgcaaattctttgaactaaaatttccgtcttcttggtttcattttcattttttttccagagaaggcaggcctttgccgtcacatcatcggaaccctatggcggtctcaagctgtgctagggcttttccatcctttgaatgtcgttcggatgccgaattctctggcggtattccccgccacgacattcctaactccggcaaggccagcattttgagtcacggatcgtccattcacggtctgtcttctcttatttataggtttcctccgaactttgttaggcagttgagcattaaggctcggaggaactgcagcaacatcggtgtggctcaagttgtggcggcttcgtggtctaacaataactcatctcctgatttcactccggtggctaaggccgtcgatgccgccgccattgctcctgttgataccacggtagttaatgaggacgtggcgctggtggaaaatgagacttgtaatgatcaaaatgtactgtttgacagtttgccaagtgtgaaatacgcttcgtttttgaattctgatgggagtgtcgctattcatgccggtgaaaggttgggacgtggcattgttacggatgcaattactaccccagtagttaacacatctgcttatttcttcaacaagacttctgagctcattgattttaaggagaaaagacgtgcaagttttgaatatgggcgctatgggaacccaactactgttgttttagaggagaagataagcgcactggagggtgctgaatcaaccttgttaatggcatctggaatgtgcgccagtactgtaatgctgctggcgttggttcctgctggaggccatattgttacaaccacagactcgctataggaagacccggatctttattgaaactatacttcctaaaatggggattacggccacggtcattgacccagccgatgtcggaactctggagttggctctaaatcagaagaaagtgaatcttttctttaccgagtctccaacaaatccattcctcagatgtgtagacattgagctggtttcaaagctttgtcatgaaaaaggagccttggtttgcatagatgggacgtttgcaactcctcttaatcaaaaggcccttgctcttggggctgacctcgttctgcactctgcaacaaaattccttggtgggcataatgatgttctcgctggttgcattagtggtcctgtaaagttagtttcagaaatacgtaacctgcatcacatcctgggtggtgctctcaatccgaatgccgcatatctaattatccgaggcatgaagacgctgcatcttcgtgtacagcaacaaaactctactgcattgaggacggccgagattttagaggctcatcccaagctgagacatgtctattatccaggcctgcacagtcatccagaatatcacattgcaaagaaacaaatgacaggttttggtggcgtggtcagttttgaggttgatggagat

SEQ ID NO: 5813 - DNA, 626 bp, Artificial
  Synthetic
cccacgctccgaaagaagaggaggtggtaaatgtaacgtgggagattgacgtcttccagttgtcccttgctgcctcatttgcgatttcatcctcccttcagtccacaccactagtcttttcactctagttttttcgctgagttcatacattaactgagaacgaaaatggagggtgaattgaagcccatggatgcagagcaactgagagaatatggtcacaaaatggtggatttcattgctgattattacaaaaatatcgagaactttcctgttctcagtcaagttcagcccggttatctacgtaaggtacttcctgaaaccgcacctgctcattctgagacattggaagacgttcttgaagatgttcagactaaaatattaccgggggtgactcattggcagagcccagattactttgcatattttccttctaacagtagtgtagctggatttttgggggagatgctcagtgctgggattaacatggttggttttagttggataacttccccagcagcaaccgagctcgaaatgatcgttttggattggcttgctaaagcccttaagatgcctgatgaattcctttcaacaggtcaaggaggtggagtcatacagggcacagcaag

SEQ ID NO: 5814 - DNA, 622 bp, Artificial
  Synthetic
ccgctccgtaaccgtttacctgaaactgcccatatcgccccgaatcatttgacaccattatgaaagatattcaaaaccatattgtccctggtatgacccactggttaagccctaatttctttgcattttttccagccaccgttagctccgctgctttcgtcggtgaaatgctgtgcacttgtttcaactccgttggttttaactggctcgcgtcaccggctgttacggagctagaaatggtagtcatggactggctcgcaaatatgctaaaactaccaaaagccttcatgttttctggcactggtggtggtgtacttcaaggtacaaccagtgaagctattctctgtacactaatcgccgctcgtgaccgaaagctcgaaaccctaggtgttcataatgttggaaagctcgttgtctacggctctgatcaaacgcactctacgtataccaaggcttgcaagctggctggtattttcccatgcaatattagagctatacctacgtctgttgaaagtaatttctctttatctcctgtggtcctacgtagagttattgaagctgatgtggctgccggattggtcccacttttcctctgtgctactgtagggaccacttcaactac

SEQ ID NO: 5815 - DNA, 618 bp, Artificial
  Synthetic
accaccagccaacactatcggaattggttcgggagcaggtcaagcaggaggcatggcggcggcggcggcggcgaagatagcgccgtcgatgctctcgtcggacttcgccaacctcgccgcggaggccgaccgcatggtccgcctcggcgccgactggctccacatggacatcatggacgggcactttgttcctaatcttactattggagctccagtgattcagagcttgaggaagcacaccaaggcatatttggactgccatcttatggtgaccaatccttcggattatgtagaaccattagcaaaagctggtgcctcaggtttcacattccatatagaagtatccagagacaattggcaagaactcatccaaagtatcaaagcaaagggtatgcgaccgggtgtatcattgaggccaggcactcctgtggaggaagtttttcccctggtggaggcagaaaatcctgttgaattggttcttgttatgacagttgaacctggctttggtggtcagaagtttatgccagaaatgatggaaaaggtgcgtgccctgagaaagaagtacccatcccttgacatcgaggttgatggtggtctgggtccttccaccattgatgt

SEQ ID NO: 5816 - DNA, 603 bp, Artificial
  Synthetic
gaaagatggccaagattgcgccatccatgctttcctcggacttcgccaatctcgcagccgaggcacagcgaatgctggattgtggagcggactggctacacatggacatcatggatgggtgaggaagggatagatgctttgaaaacctctgatctcgtgtgatcccgcaggcattttgttccaaacttgactattggagctccggtggtaagttcgctgcgaaagcatacaagtgcttatttggattgccaccttatggtgacgaatccactcgactacgtagagcctcttgccaaggccggggcgtctggcttcactttccacattgaagcttctcgagataattggacacaaatatcaaagaaggtcaaggaatgcggcatgaaagttggaatttgcctcaagcctggaactccagtcgaagaggtgtaccctctagtaagtcttgatacgtatgtaaaagcttgtgctcaaacgcaacacttcttccaggttgacagtggtgatattgatttagtgttgatcatgactgtcgagccaggatttggaggtcagaagttcatgccggaaacaatgagcaaggtgacacagaattatgttttt

SEQ ID NO: 5817 - DNA, 612 bp, Artificial
  Synthetic
gggccaagattgcgccatccatgctttcctcggacttcgccaatctcgcagccgaggcacagcgaatgctggattgtggagcggactggctacacatggacatcatggatgggcattttgttccaaacttgactattggagctccggtggtaagttcgctgcgaaagcatacaagtgcttatttggattgccaccttatggtgacgaatccactcgactacgtagagcctcttgccaaggccggggcgtctggcttcactttccacattgaagcttctcgagataattggacacaaatatcaaagaaggtcaaggaatgcggcatgaaagttggaatttgcctcaagcctggaactccagtcgaagaggtgtaccctctagttgacagtggtgatattgatttagtgttgatcatgactgtcgagccaggatttggaggtcagaagttcatgccggaaacaatgagcaaggtgaaagctcttcgagctcgctatccaaaactagacatcgaggttgatggcggtcttggcccttcgacgatccagcaagccgccgatgctggagcaaactgcatcgtcgctggaagctcggtttttggagctccagatccgg

SEQ ID NO: 5818 - DNA, 816 bp, Artificial
  Synthetic
ttcagaggttaaaaatatcgaaaatgcacgcctctttttctctctctcgacatcaggctatttcttctaaaacccataacaaatttcatccttcacacgtcggatcaagcagccgccgaatctatttctggattcagacgtcttaatcctaagaaaaacaaacgaggccttagtattactactccgaaataaagagagagaagctacttacgccggcaccggactttagattgaatggagaatttaacggccgatagggaggaggagaagatggtgaaagcaatcatagcgccgtcgatgctgtcatcggacttcgctaatttggcatctgaagcacagcgcatgctcaattacggtgctgattggcttcacatggacatcatggacggtcactttgtcccaaatcttacccttggtgctccagttatcgagagtctgcgaaagcatacaaaggcatatctggactgccacctcatggtcactaacccccttgattatgtggaaccgttaggcaaagctggtgcctcggggtttactttccatgttgaggcatctagagataactggcaagagcttgttcaacagataaagtctaagggcatgaaacctggagtttctttgaagcctggtacaccaattgaggaagtgtacccactgcttgatggtgaaaactctgtcgaactggtcctagtgatgactgttgaacctggatttggcggacaaaagtttatgccagagatgatggataaggtacggactctcagaaagaagtatccatcgcttgatatagaggtcgatggtggtttaggaccttca

SEQ ID NO: 5819 - DNA, 623 bp, Artificial
  Synthetic
gaaagagagagagagagagagagagagagagaagcgtttgggagccatggaagctacactcagcctccttccttcatcccgaccccttctgttctccggcaaggcgaaattcccgttgttgtcaccttcggctccccacagtggcgttgctcttcttcacgctcgagcccagctcccgtcatcgtcctcctcctccttggaaagggtcgttctgcctgccagagcttcgattgagcatgctttccagagcgttgtcaacaacaaggcgctccggaactctgccttcctggcgatgaacacgctcgtggcggtgcttccggccattgcagaggaggaagagaaggggaagatctttgacttcaaccttacgcttcccatcatcgtggtggagtttctggtgctgatgtacgcgctcgacgccatattcatcaagccggtgtcaaaggtgatggatgagcgggatgaggcgatccggcagaagctgatgggagtcagggacaactcgggggaaatcaaggcgctgcaggaggaggctgaggggatcctgaaggccgcccgtgcagagaccacggccgccctgaaccagatgaagcgtgagacagccgccgccctcgacgagaaac

SEQ ID NO: 5820 - DNA, 718 bp, Artificial
  Synthetic
accagtggatggcggcggctatggcgacttgcagtgccggagctctggtcgtgcgctcggcatcacttccatgcaagggggggttgccgtcgagcagcaaagccaaggttggttttctcactaaactggggagagccctggacagtggtgcgttgcggaacgcagcattcggggcgctgaacctggcgacgctgagcttgcccgcagctttggcactggctgccgaggaggagaagaaggagcccgggaagctgttcgacttcgacgccaccttgcccataattgtggccgagttcctgtttctcatggtcgctctggacaagatctggttcacgcctgtcggcaagatcatggacgagcgggacgagatgatccggaacaagctcgagagcgtcaaggacaactcggaggagataaagaagctccaggacgaggccgaggcgctgattcaggcggctcgagccgagaccaccgccgcgttgaacaagatgaagaaggagacggccgcggagctagaggcaaagttgcaacagtcgagggagaggatcgagcaggagctggcccaagcgcttgccaacttggaagagcaaaagcaggagacgctcaagagcctggagcagcaagtgcaggagctcagcgacaagatcgtggagaaggtccttcccgtcaaggccagcaaataaacactcccgcctcgtacctgctcctcctcctcctc

SEQ ID NO: 5821 - DNA, 611 bp, Artificial
  Synthetic
gaaccatccgtggatagctaggtgtacaggagaagaaagaagggaaagagagagagagagagagagagagagagaagcgtttgggagccatggaagctacactcagcctccttccttcatcccgaccccttctgttctccggcaaggcgaaattcccgttgttgtcaccttcggctccccacagtggcgttgctcttcttcacgctctagcccagctcccgtcatcgtcctcctcctccttggaaagggtcgttctgcctgccagagcttcgattgagcatgctttccagagcgttgtcaacaacaaggcgctccggaactctgccttcctggcgatgaacacgctcgtggcggtgcttccggccattgcagaggaggaagagaaggggaagatctttgacttcaaccttacgcttcccatcatcgtggtggagtttctggtgctgatgtacgcgctcgacgccatattcatcaagccggtgtcaaaggtgatggatgagcgggatgaggcgatccggcagaagctgatgggagtcagggacaactcgggggaaatcaaggcgctgcaggaggaggctgaggggatcctgaaggccgcccgtgcagagacc

SEQ ID NO: 5822 - DNA, 614 bp, Artificial
  Synthetic
cccacgcgtccgcgttcggggtagatagcccgcttcctcctctctctctcagctcaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggagg

SEQ ID NO: 5823 - DNA, 578 bp, Artificial
  Synthetic
cccaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggaggcgaagctggacgaggg

SEQ ID NO: 5824 - DNA, 459 bp, Artificial
  Synthetic
ccccccggccacctcctccactctcggcggcgggggcctcatcgatggcgtcgaggatggcgctccggcccaacgacgtcacgctccgcctcaccccgcccctcgccgccgccgcgcggcgcaaccgccgcgccgccgccggcggtgtcagggtctacgccgtcgcgtccggggccgtctccaccaaggttgagaacaagaagccatttgctcctccacgagaggtgcacgtccaggttacacattccatgccaccccagaagattgaaatattcaagtctcttgatgattgggccagagataatattttgtcccaccttaagcctgtcgagaaatgttggcaaccacaggattttcttcctgatccagcctcagatgggtttcatgatgaagtcaaagaacttagagaacgtgccaaggaaattcctgatgattattttgtttgtttggttggagaca

SEQ ID NO: 5825 - DNA, 638 bp, Artificial
  Synthetic
gggtgggcttcggatccgctcgacctcctcgcagctctccagcaatggccgccgtcgccaacgtttgcgggatgcctatgaggagcgcattcgttccatgccacgaaatccacctcgtcaagccgccggttgtctccatcacttcggtgaggagctccagatttcccggaatcgccatgactgctacggctccagcaacggagaacattgcaaagcaagtcagcaagccttcccaaatcatgcattctctttctccggagaaggtcgagatgtttaagtctctcgagagctgggccgaggaagcgatccttccattcctgcggccagtggagaaatgctggcaacctcaggactacctcccggagccgtcctcggagagcttctacgacgaggttcgcgagctgaggaagcgggccgagtgcctgcccgacgactacttcgtctgcctcgtcggggacatgatcaccgaggaagctctgccgacttacttgacaatgctcaacactctggacggctcccgagacgagaccggcgcgagtcagagtccctgggccgtctggggacgtgcttggacggcagaggagaaccgtcatggcgacctgctcaacaagtatctctacctcactggacgcgtcgat

SEQ ID NO: 5826 - DNA, 531 bp, Artificial
  Synthetic
tctttaaaagagggcgagtgaggagagagagagggggaagagagagagagagcgaggagaggagagagaagataaaggttggactgcatggcttcatctctcctgactgacctcctcaacctcgaccttactgatgtcactgagaatatcatcgctgaatacatatggattggtggatctgggttggatctacgcagcaaggccatgacattaagccgccctgtaaagagccccagtgagctcccaaagtggaattatgatggctccagtactggtcaagctcctggggaagacagtgaagtcatcctctacccccaagcaatattcaaggatcctttccgccggggaaacaacatttaggtgatatgtgattgctacactcctgctggagagcccatccccactaacaagcgctgcaatgctgccaagattttcaacaccaaggaagtcaaggaagaagagacatggtttgggctagagcaagagtacacactactgcagaaggatgtgaaatggcctctgggttggcct

SEQ ID NO: 5827 - DNA, 519 bp, Artificial
  Synthetic
cccacgcgtccgaaacacactgattattttctctccgacgccgccatgtctctgctctcagatctcgttaacctcaacctcaccgatgccaccgggaaaatcatcgccgaatacatatggatcggtggatctggaatggatatcagaagcaaagccaggacactaccaggaccagtgactgatccatcaaagcttcccaagtggaactacgacggatccagcaccggtcaggctgctggagaagacagtgaagtcattctataccctcaggcaatattcaaggatcccttcaggaaaggcaacaacatcctggtgatgtgtgatgcttacacaccagctggtgatcctattccaaccaacaagaggcacaacgctgctaagatcttcagccaccccgacgttgccaaggaggagccttggtatgggattgagcaagaatacactttgatgcaaaaggatgtgaactggccaattggttggcctgttggtggctaccctggccctcagggaccttactac

SEQ ID NO: 5828 - DNA, 1000 bp, Artificial
  Synthetic
aacagtcctctgttctatttatttgcattacgatgaccgacaacattaacatttcgaaagcttccaacttgtcaaaatacctggacctcccccagcacggagctgtcctggccgagtacatctggatcgatgcccatttcaacatccgatccaagtgcaagactctagacaagaagcccacttccatcgaagacctccccgagtggaactttgacggctcctccacagatcaggctcccggccacgactcggatatctatctccgacccgccgccatctaccccgatcctttccgacgaggcgacaacattattgttctggccgagtgctggaacaacgacggaacccccaacaagttcaaccaccgacacgagtgcgccaagctcatgagcgcccacgagaaggaggtcatctggttcggaatcgagcaggagtacaccatgttcgacgagagcgataaccccgtcggatggcctaagggcggtttccccgctccccagggcccctactactgtggtgtcggaaccggcaaggtctttgctcgagacgttgttgaggcccactaccgagcctgtctctactccggaatcaacatctccggtatcaacgccgaggtcatgccttcccagtgggagtaccaggttggtccctgcgagggtatctccatggccgatgagctgtggatgtcccgatacctgctgcaccgagttgccgaggagtttggcatcaagatctccttccaccccaagcccctgcagggagactggaacggagccggctgtcacaccaacgtgtccaccaagtcgatgcgagagcccggtggaatgaagcacattgaggctgccatcgagaagcttgctgcccgacacaaggagcacattgccgtctacggcgaggacaacgacatgcgactcaccggccgacacgagaccggctccatcggctctttctcttccggagttggcaaacgaggctgctccatccgaattcctcgatctgt

SEQ ID NO: 5829 - DNA, 1633 bp, Artificial
  Synthetic
cggacgcgtgggttctctctcttcaacactatttttccagcatagcattaccaacttagttggttaggtgaagatggctcagatcttggctccatctgcgcaatggcagatgagaatgacaaagagctcaacagatgctaatcccttgacttcaaagatgtggagttctgtggtgttgaagcagaataaaagacttgctgttaaaagctctgccaaatttcgagtctttgctctccaatctgatagtggcactgtgaacagagtggaacagctgctaaacttggacgtaactccatatactgacaagatcattgctgaatatatttggatcggaggatctggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccaacaaacaaacgccataaagctgctcaagtttttagcgactcaaaagttgtatctgaagttccatggttcggaatagaacaagagtacaccttactccaacaaaatgtgaagtggcctttaggttggcctgttggaggctaccccggaccacagggtccttactactgtggtgctggagcagataagtcatttggccgtgatatatcagatgctcactacaaggcttgcctgtatgctggaattaacattagtggtaccaatggagaggttatgccaggacagtgggaatttcaagtaggtcctagtgtgggaattgaagctggagatcatatctggtgtgctagatacatccttgagagaattactgaacaagcaggagttgttctctctcttgatccaaaaccaattgagggtgattggaatggtgccggatgccacactaactacagtacactgagtatgagagaagaggggggctttgaagtaataaagaaagcaattctgaatctctcccttcgtcacaaggagcatataagtgcttatggagaaggaaatgagagaaggttgactggaaagcatgaaactgcaagtattgacaaattttcatggggagttgccaaccgtggtgcctcaatccgtgtggggcgtgacaccgagaagcaaggcaaaggttatttggaagaccgccgcccagcttcaaacatggacccttatgttgtgaccggattacttgctgaaactactattctgtgggagccaacccttgaggctgaagctcttgctgctcaaaagctcgcattgaatgtttagattatttaagggcagaattatccgtaataatcttcttagagttcatgagctgctaagtgaagaaatttgtaccttgtttagattcccttttagggaaaatcttgtaaaggaaccacagtttatcagttattcctataaaagaggttccttaagacaatgagactgctttggagttgaggtgtaattgttggactactttgaacatatttatctttcatttctccagatgaatcgattacttctgccattctgatctcccgt

SEQ ID NO: 5830 - DNA, 269 bp, Artificial
  Synthetic
cggacgcgtgggacacaatctcaagattttctacttcttattacaaagattcaatcttcttgtttcttcttgcaaccatgagtctttttgcagatcttgttaaccttgacatctcagacaacagtgaaaagatcatcgctgaatacatatgggttggtggttctggtatggacatgagaagcaaagccaggactctccctggacctgtgaccgatccatcaaaacttccaaagtggaactatgatggttcaagcactggtcaagctcct

SEQ ID NO: 5831 - DNA, 406 bp, Artificial
  Synthetic
cccacgcgtccgaaaagccggtggaggatccttctgagctacctaagtggaactatgatggttcgagtaccggtcaagcacctggtgaagatagtgaagtgattctatacccgcaagctatcttcagagatcctttccgtggaggcaataacatcttggttatctgtgatacttggacaccagctggtgagccaattccaacaaacaaacgtgctaaagctgctgagatcttcagtaacaagaaggtctctggcgaggttccatggttcggcattgaacaagagtacactttacttcagcaaaacgtcaaatggcctttaggttggcctgttggagcgttccctggtcctcagggtccttactactgtggagttggagctgacaagatttgggggcgtgacatttc

SEQ ID NO: 5832 - DNA, 3895 bp, Artificial
  Synthetic
gaattcggaggatcagcaatttttgttcttcaatttcatctcctctctgaatcttcagctcagatcgacaatagtcacagcttcaagccctaatttaaccaatgtcccatctcagttcttccatggaagcttctgcaaaccacagagcccccaaatggatcctttacaatccaatcagtagaaccctaattcgaatttcacaaaatacccatgaaaatcctcattgttctgctttccctgcttcattcgattctggttcaaaaccaaaaccaaaaccaacttcatctcccggccattctccccgatctccggtgaagatggcacagattttagcaccttcactgcaatgtcagatgaagataacaaatacaacaacaaatgctgcaagcccaattactacaaagatgtggggttctctaatgtttaaccagaaaagaagtggacttactaaaaacgcttctaaattcaaagttatggttgttaaatcggaaaacggtaccatcaacagaatggaagatctattaaatttggatactactcccttcactgataagatcatcgctgaatacatctggattggtggaacgggaattgatatgcgtagcaaatcaaggactatctcaaagcctgttaaatctcctgctgatcttcctaagtggaattatgacggttcaagtactggacaagcacctggagaagatagtgaagtgattctataccctcaagcgatttttaaggatcctttcaggggtggtaacaatatcttggttatatgtgatgcatacacaccacaaggggagccaattccaacaaacaaacgttacaaagctgctcagatctttagtgatcagaaggtcattgacgaaatcccatggtacggtattgagcaggaatacaccctgctccaatcaaatgtgaagtggcctcttggttggcctgttggaggattccccggtcctcagggtccttactactgtgcagctggagccgacaaatccttcggaagagacatttcggatgctcactacaaagcttgcttatatgctggtattaacatcagtggcactaatggagaagtcatgcctggccagtgggagtatcaagtcggtccaagtgtgggcattgaagctggagaccatgtatggtgttctagatacattcttgagagaattactgaacaagctggtgttgttctgtctcttgatcctaaaccaattgagggtgactggaatggtgcaggatgccatactaactacagtactaagagcatgagagaggaaggaggattcgacgtgataaagaaagcaattctgaatctgtctcttcgccataaagagcatattagtgcatacggagaaggaaatgaacgaaggttgaccggaaagcatgagacagccgacattaacaccttttcatggggagtcgctaatcgtggttgttcaatccgtgttggacgtgacaccgagaaagaaggaaaaggttacttagaggaccgccgcccatcttcaaacatggatccatatgtcgtgacagggctgctagcagaaagtactttattgtggcgaactgaaacatcttagtagccagaggaaaagaaagcaaaagcgattcccgtagtagcggcgagcgaaatgggagcagcctaaaccgtgaaaacggggttgtgggagagcaatacaagcgtcgtgctgctaggcgaagcggtggagtgctgcaccctagatggtgagagtccagtagccgaaagcatcactagcttatgctctgacccgagtagcatggggcacgtggaatcccgtgtgaatcagcaaggaccaccttgcaaggctaaatactcctgggtgaccgatagcaagcgacgaaatgcttcggggagttgaaaataagcatagatccggagattcccgaataggtcaacctttcgaactgctgctgaatccatgggcaggcaagagacaacctggcgaactgaaacatcttagtagccagaggaaaagaaagcaaaagcgattcccgtagtagcggcgagcgaaatgggagcagcctaacacggggaggtagtgacaataaataacaataccgggctcttcgagtctggtaattggaatgagtacaatctaaatcccttaacgaggatccattggagggcaagtctggtgccagcagccgcggtaattccagctccaatagcgtatatttaagttgttgcagttaaaaagctcgtagttggactttgggttgggtcgtccggtccgccctttgggtgtgcaccggtcgtctcgtcccttctaccggcgatgcgttcctagccttaattggccgggtcgtgcctccggtgctgttactttgaagaaattagagtgctcaaagcaagcccaagctctggatacattagcatgggataacatcataggatttcggtcctattgcgttggccttcgggatcggagtaatgattaacagggacagtcgggggcattcgtatttcatagtcagaggtgaaattcttggatttatgaaagacgaacaactgcgaaagcatttgccaaggatgttttcattaatcaagagcgaaagttgggggctcgaagacgatcagataccgtcctagtctcaaccataaacgatgccgaccagggatcggcggatgttgcttttaggactccgccggcaccttatgggaaatcaaagtttacgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagagaagaagtccaaatcgttgaagaagaacaaatggcgtcaaaggataactacgaagaagccattgctgggctcaagaagcttcttagcgagaacaatggtctggaggcagttgccgcggctaagatcgaacagataacagctgaattacagactactgctaacgggaaagccgacggattctgcccggttgaaaggatcaagactggattcgtccaattcaagaaggacaaatacgagactgatccaaaactgtatggggaactttccaagggtcagagccccaagttcatggtgtttgcatgctctgactctcgagtgtgcccttcccacatcttgggattccaaccaggagaagcttttgttgttagaaacattgctaacatggttccagcctattgtcaaaacaggtactctggagttggagctgccatagaatatgctgtcttgcatctcaaggttgagcatattgtggtgattggacacagctgttgtggtgggatcaaaggacttatgtctctttctgacgatggctccacttccactgatttcatcgaagactgggtcaaaatcggtttaccagccaaatccaaggttaaggccacaggcggtgatgcaccaattgcagacctttgcgagatgtgtgagaaggaggcagtgaatgtatcacttggtaaccttttgtcatacccattcgtgagaaatgcatgcattaacaacatattgacattgaagggaggtcattacgatttcgtcaagggatctttcgagctctgggacttggagtttggactctcccctacttccaccgtatgaaaaactactacatctccagttccacaccatgtgtcattgatgctcatcaataacatccccatctcttcgaaaatctttgtttttccttcacct

SEQ ID NO: 5833 - DNA, 863 bp, Artificial
  Synthetic
cccatccctgcttcctcttctacacctcattttccgcttgcatcttgctcattcagatctcttctgctttgagcaatggccaacctcaccgacctcgttaacctcaacctcagcgactgcagcgacaagatcatcgccgagtacatctgggttggaggatcgggcatagacctcaggagcaaagcgaggactgtgaaaggccccatcaccgatgtgagccagctgccgaagtggaactacgacggctccagcaccgggcaggctcccggcgaggacagcgaagtgatcctctaccctcaagccattttcaaggacccgttcaggaggggcgacaacatccttgtgatgtgcgactgctacacgccacaaggtgagccaatccccactaacaagaggcacagtgccgccaagatcttcagccaccctgatgttgttgctgaggtgccatggtacggtattgagcaggagtacacactccttcaaaaggatgtgaactggccccttggctggccagttggtggcttccctggcccacagggaccatactactgcgctgccggtgccgaaaaggcgttcggccgcgacatcgtggacgcccactacaaggcctgcatctacgccgggatcaacatcagtggcatcaacggggaagtcatgcccggccagtgggagttccaagttggcccgtcagttggcatcgccgctgctgaccaagtgtgggttgcccgctacatcctcgagagggtcacagaggtggccggagtcgtgctctcccttgacccgaagccgatcccgggtgactggaatggcgctggtgcccacaccaacttcagcaccaagtcgatgagggagccgggaggcta

SEQ ID NO: 5834 - DNA, 634 bp, Artificial
  Synthetic
gaattcaaacagagagctagatagataattggcattgttaattcatcatattcattcgtcaaatatgtctcttctaacagatcttatcaacttagatctctcagacaaaactgagaagatcatcgctgaatacatatggatcggtggatctggaatggaccttcgaagcaaaggaaggacattacctggacctgttagtgatccttcaaagctaccaaaatggaactacgatggttctagcactggacaagctccaggagaagatagtgaagtcatcctatatcctcaggctatcttcaaagacccattcaggaggggaaacaacattcttgttatgtgtgatgcttacactccacaaggagaaccgatcccaactaacaagagatgcgctgctgcaaagatcttcagcaatcctattgttgagaaagaagttccatggtacggaattgagcaagaatacaccctcttgcagaaggatattaactggcctcttggatggccccagggaggctttcctggaccacagggaccttactactgcggtactggtgcggacaaggcattcggacgtgacattgttgatgcccattacaaagcctgtctctatgcaggagttaacatcagtggaatcaac

SEQ ID NO: 5835 - DNA, 638 bp, Artificial
  Synthetic
ccacgcgcgtcgcggggcggcaatcgcgtctcatcaaggtttttcgtgtggtgttgaggatccatggctaggaagatgctcaaggacgaggaggtggaggtggccgtcaccgacggcgggagctacgactacgacctgttcgtgatcggcgccgggagcggcggcgtccggggctctcgcacctccgcgtccttcggggctaaggttgcgatttgcgagctcccgttccatcccatcagctcggattggcaaggagggcatggtgggacgtgtgtgatacgtggttgtgtgcctaaaaagatactggtgtatggttcatctttccgcggagaatttgaggatgcaaagaattttgggtgggaaatcaatggggacattaacttcaactggaaaaggctgctggaaaataagactcaagaaattgttagactaaatggagtataccagaggattcttggcaattctggtgtgacaatgattgaaggggcaggcagtttggttgatgctcatacagttgaagtcacaaagccagatggttcaaagcaaagatatacagcaaagcacatattgatagcaactggtagccgagctcaacgtgtcaacattcctgggaaggagttagctattacttcagatga

SEQ ID NO: 5836 - DNA, 356 bp, Artificial
  Synthetic
attcggcacgaggcaattcccacacgtcttttagagtatatatagaccagacttgtaatcatggctaggaagatgctgattgatggagagttggagaaatccgatcaagaagaacagcactatgactttgatttgttcgtaataggtgctggaagtggtggggttcgagctggtcgattttctgcccaatatggagctaaggttgcgatctgtgagcttccatttcatcctatcagctctgaacttagtgggggagttggtggaacgtgtgttattcgtggttgtgtccctaaaaagattttggtttatggagcagcctatgggccggagctggaggatgcaaggaattatggatg

SEQ ID NO: 5837 - DNA, 599 bp, Artificial
  Synthetic
aaaacactaacaaattcaaaatggttaaagctgtcgttgccggagccgctggtggtattggccagcccctttctcttctcctcaaactctctccttacgtgaccgagcttgctctctacgatgtcgtcaactcccccggtgttgccgctgacctctcccacatctccaccaaggctaaggtcactggctaccttcccaaggatgacggtctcaagaacgctctgaccggcgccaacattgtcgttatccccgccggtatcccccgaaagcccggtatgacccgagacgatctgttcaagatcaacgctggtatcgtccgagatctcgtcaccggtgtcgcccagtacgcccctgatgcctttgtgctcatcatctccaaccccgtcaactctaccgtccctattgctgccgaggtcctcaagaagcacaacgtcttcaaccctaagaagctcttcggtgtcaccacccttgacgttgtccgagcccagaccttcaccgccgctgttgttggcgagtctgaccccaccaagctcaacatccccgtcgttggtggccactccggagacaccattgtccctctcctgtctctgaccaagcct

SEQ ID NO: 5838 - DNA, 745 bp, Artificial
  Synthetic
ctttctccatttcaattcattaactattccgaatgactttatccatgttgagatctgtcgtccggaggaccacaacttcaggcgcgtctcgcctcacgcgccgccaattctcatcgagggccgcaccggagaggaaagtcgcaattttgggagcagcgggaggaatcggacagcctctttcacttctgatgaagttgaatcctttggtatcaacgctttcactctacgatattgccggcactcctggtgttgccgctgatgttagccacatcaataccagatctcaggttgctgggtttgcaggagaagaccagctagggaaggctctggaagggtctgacgtggtcatcattcctgctggtgtgccccgcaaaccgggtatgacccgtgatgatctgttcaacattaacgctggtattgttaaatcattatgcacagctatcacaaagtattgccccaatgcccttgtcaatatgatcagcaaccctgtgaactccactgtgccaattgcagctgaggtgttcaagaaggctgggacatatgatgaaaagaggctctttggagtcaccacacttgatgtggttagggcaaagactttctatgctggaaaagctaaagtcaatgtctccgatgtcattgtccccgtggttggcggtcatgctggcataaccatcctcccgctgttgtcccaagccactccaaaggcaaatttgtcagatgaagaaattgttgcgctcaccaagcg

SEQ ID NO: 5839 - DNA, 362 bp, Artificial
  Synthetic
cttaaacagcttcctaacgagaggaaactgaggaacacaacaatggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgc

SEQ ID NO: 5840 - DNA, 686 bp, Artificial
  Synthetic
gaggtgattattagggcaatgggtttagagatggcccaggatcgggcgagggagcggatgggccgaatctcatcacacctgaagcgcagtgatgtgtgtatggaggtgtgccgtgctaagggggccgccacggggttcagggtggctatactgggggcggcaggaggcatcgggcagcctctatcgctgctaatgaaaatgaatccgctggtttccacgttgaacctgtatgatgtggtcaacactccgggtgttaccgcggacttgagccacatagactcaacagcagtggtgagtgtgcgaggcttcctggggaaagacgcgctccattcggcattggaaggggtggatctggtcataattccagcaggtattccccgaaagccagggatgagccgggatgacttgttcaagataaacgcgggcattgtgcgaacactttgtgagggcgttgcacgggcatgcccgcgggcacttatcaacattatcagcaacccggtgaactccaccgtgcctatagcagctgaggttttcaagaagtctggcacgtacgacccacgacggctgtttggtgtcaccacccttgatgttgttcgaggcaacacatttgtggccgaggtcgtgggagtggatccaaagctcatcaatgtccctgtggtgggagggcacgcaggcatcactatctt

SEQ ID NO: 5841 - DNA, 639 bp, Artificial
  Synthetic
acgcgtcgtgaaaagcctttccaccgccattgctaagtactgcccaaatgctattgtaaacatgatcagcaatccggttaattcaacagtaccaatagcagccgaagtattcaagaaggcaagtacttatgacccaaaaaagctctttggagtgacaacgctggatgttgttcgagctcgcaccttttatgctgccaaaaagggactaaatgtcaacgaggtgaatgtgcctgttatcggaggacatgcaggcataacgattcttcctattttttcccaggcaactccccaagtgtcttcatctgctgaagaaattgatgcattgacgaagcgcacgcaggatggtggaacggaagtagtgcaagcgaaggctggcaagggttctgccacactttcaatggcatatgctggtgcactttttgctgaagcttgcctcaaaggactgaatggagtacccgatgtagtggagtgcagctatgtggcttcgaacttggtgcctgagctccccttctttgcttccaaggtggttcttggacaagggggactcgagcaggttctagaaataggtaaactaactccatacgaagaaaaatgtctagatgcgatgaaagctgagctgaaaggctcgatacagaaagg

SEQ ID NO: 5842 - DNA, 1045 bp, Artificial
  Synthetic
gtttgattgatcgatcgatcgatcgaggatgtcgtcgaagcagcgggcagcgatgatcttcaagcgggctatggcgacagtgcccgggggaaagccgctgcccgtgaggaagcctctgccttatcgtagggtcgcggttctgggggcggccggcggcattgggcagccgctgagcatgctgctcaagctcaatcccctcgtctccaagctctcgctctacgatatcgctggaacccccggcgtgtccactgatctatcgcacatcaacacgaggacagaggtgcatggatttgctggggatgatcagctcaaggacgctctaaaagacgcggatctcgttatcattcctgccggtgttccccgcaagcccgggatgacgagggacgagcttttcgatatcaatgcggggattgtgaagaagctgtgccaagccatcgcgaagcactgccctcttgcattgattaacatgatcagcaatcccgtgaattccaccgtgccaatcgcggcagagatgctcaaggccgagggaacttacgaccacacgaggcttttcggtgtcaccacgctggatgttgtgcgagcgaggactttctacgccaaagccaagaacctgcccatcgaagatgtggacgtccctgtcgttggtggacatgccggcaagaccattcttccactgttctcacaggcaaccccacaagtacccctcacccaggaagaggtcgagaacctgacgaagaaggtacaggacggtggaacggaggtggttcaagccaaagctggcaagggctctgcgacactgtccatggcatatgctgctgctctttttgccgagtcctgcttgaaggcgatgaatggagagcaaaacgtcgttgagtgcgcgtacgttgcgtcgtcagtgacagactatcccttctttgcatcgaaggtcgagctcggcaagtacgggttggtgaaagctctggagctgggaccgatctccaagtacgagcaggcatgcctggacgagatgaaggacgagctgatggcctccatcgacaagggtgtc

SEQ ID NO: 5843 - DNA, 967 bp, Artificial
  Synthetic
tggattggtcttcttgctttggatatacactttgtggagttaatctgtttctcatagaatagaagaagatggatcaatcctcatcaatggttcgcctggctcgctttgctgcccatctggctcctcccttgaatgaaggcggaagagcagttcatatggagagttgccgagcgaagggtgcagcacctggcttcaaggttgctgtgcttggggcttcgggtggcattgggcagcctctttcccttttgctcaagatgaaccccttagtttctgtgctccatctttatgatgttgtcaatacactcggagtgactgccgatataagccacatggatactagcacagtggtacgtggctttgttgggaaagatcaattggaggctgctttagagggcatggagcttgttgtaattccagctggtattccacggaaaccagggatgactagagatgatctattcaagatcaatgcgggcattgtgcgcacactttgtgaaggaattgccaaatgttgcccgaatgctatagtgcatatcattagtaatccggtaaattccacagttccaattgcagctgaggttttcaagaaggctggaacatacaatccaagacggcttatgggtgttacccatcttgatgtggtgcgagcaaacacctttgcggcagaggttatgggagttgatccaaaacttgtcactgttcctgtcgttggaggacatgctggcataaccattttgccactcctttctcagattaagcctgctttttcctttaccaaggaggagactgaatttttaacaaacaggattcagaatggagggacggaggtagttgaggcaaaagcaggcacaggctcagcgacattgtcaatggcctatggagctgctaagtttgcagagtattgtttacatgccatgtgtggtgaagccggtattttggtctctgcccatgttgcttcacaggtgac

SEQ ID NO: 5844 - DNA, 565 bp, Artificial
  Synthetic
ggtagaagaagaaagagaaagaaagagaaagagacgatatccttctgtcctgttgccatggctagtgcctctttggcagcagaatgtgcgttttctctcacctcccatgtgaagaagagtaaggctggaagagagagagagaggcttccctcctccttctcctccttttcctgcctcagaggtagtagcccattgcagagaaccagcttgttgggccaggagagaagcccagctgaagcagaagcgggtcgtcgtcgtctctccccgagccgtctccgattcgcagaacaaagagttttgtctcaaacccgatgttgggcgaagtgttttgggaattattcttggtggtggagcgggttcacggctttatcctttaacaaagaaacgggcgaagcctgccgtcccccttggtgctaactatcggctcatcgatatcccagtcagcaattgtataaatagcaacattcaaaaaatatatgtgttgacccaattcaactcggcctctttgaatcggcatgtctctcgagcctactcaagcaatctgggtggttacaagagtgagggg

SEQ ID NO: 5845 - DNA, 689 bp, Artificial
  Synthetic
aaatatatacagcttattgcactttgtttttcttctcagtttgcatagaaaaatggcggttgccgccgacagccaattcgccttatcagcggcaggccaacttcataacacaacggcagcattgacaaggagaaacttgagagtagtgaatttttgtaatggagagttgatgggaaagaagctcaagtttacaaaatttcagttaaagagcaatgtggtgaagcctaatatctgcatgtcacttacagctgatgttgcaggtgaggctaagttaaaggatcttgaaccggagaaggctgatacaaggacagtagtagcaatcattctaggagggggagctggcactcgtcttttccccctcaccaagcgccgtgctaagcctgctgttccaattggaggagcatacaggctaattgatgtaccaatgagcaactgtatcaacagtggcatcaacaaagtttacattctcacccaattcaactctgcctcgcttaacaggcatattgctcgggcttacaactttggcaatggtgtcacatttggagatgggtatgtcgaggtcttagcagcaactcaaacacccggagaagcaggtaaaagatggttccaaggtactgcagatgctgttaggcaattccactggctttttgaggatcaaagaagccaggacatagaagatgtgctcattc

SEQ ID NO: 5846 - DNA, 388 bp, Artificial
  Synthetic
gcgtctgtatctgcaattggagttctcaaggtacctcctgcttcgacttccaattccaccggaaaagccacggaggcggttcccacgaggactctttctttctcctcctctgttacttcatccgacgacaagatttcactcaaatccaccgtctcccgtctttgtaaatctgttgttcgcaggaatccgatcatcgtctctcccaaagccgtctcagattctcaaaactctcaaacttgtctcgatcctgatgctagcagcagtgttttggggataatcttaggaggtggagctggaactcgtctttatccacttacgaagaagagagcgaaaccagctgtgcctcttggtgctaactataggcttattgatattcctgtgagcaact

SEQ ID NO: 5847 - DNA, 908 bp, Artificial
  Synthetic
aaagtttgaaacttgagaagaaggaaagcaagatcaaacctggggttgctttctctgttatcactactgacaatggcaaagagactctgactgtggaggctccacgttttgacagacgacgggcaaaaccaaagaatgtagcttcagtcatactaggaggaggtgctggaaccaagttattcccgctgacaagtagagctgccacccctgctgtaccggttggaggatgctacaggctaatagacatcccaatgagcaactgtatcaacagtggcattaacaagatatttgtgctgacccagtacaattctgctcccttgaatcgtcacattgctcgaacatattttggcaatggtgtgagctttggagacggatttgttgaggtgttagctgcaactcagacacctggggaaacagggaaaaattggtttcaaggaactgccgatgctgttagacaatttatatgggtttttgaggatgccaagaacaaagatgttgataatatccttatattatctggggatcatctttataggatggattatatggacttggtgcagaaccatattgaccggaactctgatattactctttcatgtgcaccagctggggacagccgagcagcagacttcgggctggtcaagattgacagtagaggcagagttgtccagtttgctgaaaaaccaaaaggttttgatctaaaagcaatgcaagtagatactactctcattggattatctccacaagaagcgaagagatccccatatattgcatcaatgggggtttatgtattcaagacagatgtattgttgaagctgctgaaatggagatatcctacagctaatgattttggctctgaaattataccagcagctataaatgagcacaatgttcaagcatacatattc

SEQ ID NO: 5848 - DNA, 648 bp, Artificial
  Synthetic
cccgggccttcgccaccttcgaatcgaaactaatcccccacacctccgcgtgcctccccccaatctcgagcgcacggaagccgccgccaatggcgctcccgaatcagcagacggtggactaccccagcttcaagctcgtcatcgttggcgacggcggcacgggcaaaaccacctttgtgaagaggcatttgactggcgagttcgagaagaagtatgagcctactatcggtgtggaggtccaccccttggatttcttcactaactgcggcaagatccgcttctactgctgggatacagctggtcaggagaaatttggtggactcagggatggttactatatccatgggcagtgtgctatcataatgttcgatgttacttctcggctgacgtacaagaatgtcccaacttggcaccgtgatttatgcagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctggcgatggtaacctccactttgtggaaacacctgctcttgctc

SEQ ID NO: 5849 - DNA, 945 bp, Artificial
  Synthetic
gcgtcgtccaaaaacccacaaggaccccgcctgtttacatcacctcacgctcgtcgctaatcactcgagccgtcaatatggctgagcaacagactcctaccttcaagcttgtgcttgtcggcgatggtggtaccggcaagaccacctttgtcaagcgtcacttgactggtgaatttgagaagaagtacatggccaccctcggtgtcgaggttcacccccttggcttcaccaccaactacggtcagatccagttcgatgtgtgggataccgccggtcaggagaagtttggtggtctccgtgatggttactacatcaacggccagtgcggtatcatcatgttcgatgtgacatcccgtatcacatacaagaacgtccccaactggcatcgtgatcttgtccgcgtttgcgagaacatccccatcgtcctgtgcggtaacaaggttgatgtgaaggagcgaaaggttaaggccaagaccatcaccttccaccgaaagaagaacctccagtactacgacatctccgccaagtccaactacaacttcgagaagcccttcctgtggctggcccgcaagctggttggcaaccccgccctggagttcgttgctgcccccgccctggctcctcccaccgcccaggtcgacgaggctctcttggagcagtacaagaaggagatggacgaggccgccgccatgcctcttcctggtgagctgtctgacgatgatctgtaaacgaatcgcacgacggcgaaaagtgttttattgatgatgctgggacatcccggattacttgaggattaagccatcggcagctggaatgaccgtttatgatacaggaaggggatttccgggtttacatgagctcgactggagagggcaaggatataatacccttggtacctcgttgggggtagattatcggggcgccgccgcagggagtgcggcaaaa

SEQ ID NO: 5850 - DNA, 655 bp, Artificial
  Synthetic
ggcccccattcctcccccaccccggtgtcctcccctccgccgctcgcgtcgccgcctttttcccctatggcgctgccgaatcaggggaccgtggattaccccagcttcaagctggtcatcgtcggcgatggcgggactggtaaaactacatttgtgaagaggcatctcactggagagtttgaaaagaaatatgagccaaccattggtgtcgaagttcaccctctagattttaccaccaactgtggtaagatccgcttctactgctgggacactgctggacaagagaagtttggtggacttagggatggatactatatccatggtcaatgtgcgataattatgtttgatgtcacttcaaggctgacttacaagaatgttccaacatggcatagggacttgtgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctggtgacccgaacctgcatttcgttgaagctgttgctcttaaacctccggaagttcccattgacctggcaatgc

SEQ ID NO: 5851 - DNA, 1367 bp, Artificial
  Synthetic
cggacgctgggacggcgcttcatgactgtttggagactattgatgagacgctggacgagctccatgaaacggtggaagatctccatttgtatccaaccaaaaaaactctccgggaacacgccggagatctcaaaacactaattagctccgccattaccaaccaggagacttgtctcgccgcttccttcttaacaccatcgcctgaattcgctctcctctagctcgcgattgcgaaaacatggctctacctaaccagcaaaccgtagattatcccagcttcaagcttgtcattgttggtgatggaggcacagggaagactacttttgttaagagacatcttactggggagtttgagaagaagtatgaacctactattggtgtggaggttcatcctttggatttcttcacaaactgcggaaagatccgtttttactgctgggatactgctggacaagagaaatttggtggccttagggatggatactacatccatggtcaatgtgcgataataatgtttgacgtcacagcaaggctcacatacaagaatgttccgacatggcatcgtgatctttgcagggtgtgtgaaaacatcccgattgttctgtgtggaaacaaagtcgatgtgaagaacaggcaagtgaaggcaaagcaagtcacattccacaggaagaagaatctgcagtactatgagatatcagcaaagagcaactacaactttgagaagcctttcttgtaccttgctagaaaactggctggagaccaaaaccttcactttgtggagacaccagcgcttgctccaccagaggttcacattgacattgctgatcagcagaagaacgaggccgagctcttacaggctgcagatggagaggcagaagaagaaacaacagatagaagaggtggagaggatagtgaggctgaagcaagcagaggcagagatgtttcagttaaaagcaaacgaggcaaaagtggaagcagagagattggaaaggattgtgaaagcgaaaaaggagaaaacagaagaggaatacgcaagtaactatttgaaactgaggctgagcgaggcggaggcagagaaagagtatctgtttgaaaagataaaagagcaggaaagtggtgggaatggtggtgaagcgtcacaagcagtgatgtactcaaagatcagagaaatgctgcatggatacaatgcatcgtcgccaagggtagatccaagatcaaaccagcgaaatcctttcagatccaatccttagatgtttgtattgtctctctttgtttgtattaaaaaaaaaatccgaatcaattaaggttggatttgtgtgtgaagtattgtggtctttgtattcaaattttgcccatgaaaaacaaaa

SEQ ID NO: 5852 - DNA, 662 bp, Artificial
  Synthetic
aaatcgaatcgacattgttatcgacttcgatcgcattttctgatagccttctttgcttaagccatggctcttcccggtcagcagcaggctgattgcccgaacttcaagcttgttattgttggcgatggaggaacaggaaagacaacctttgtgaagagacacttgacaggagaattcgagaagaaatacgaacctacaattggagtggaagttcatcctcttgacttctttaccaactgcgggaagatccgcttttattgctgggatactgctggccaggagaaattcggaggcctccgagatggttactatatccatggtcagtgtgctatcattatgtttgatgtgacatcacggctgacctacaaaaatgtgccaacctggcacagggacctctgcagggtttgcgagaacattccgatcgttctgtgtgggaacaaggtggatgtgaagaacaggcaagtgaaagcgaagcaggttaccttccacaggaagaagaatctccagtactacgagatctcagccaaaagcaattacaactttgagaagccatacctgtaccttgctaggaaattggcaggtgatccaactcttcactttgtggaatctccggcacttgcacctcctgaagtacaaatagacttggctcaacagcaacaata

SEQ ID NO: 5853 - DNA, 1386 bp, Artificial
  Synthetic
gaattcaagggactttactgatcgagccaaagcctcaggaaccaactaagcaccagtatgactgggatgcggcaactacagctgcatttctactaaaatatggactttctggtgaattcaaactcaacattgagtgcaaccatgctacactttctggtcacagctgccaccatgagcttgagaccgccagaaattttgggatgcttggaaacattgatgcaaacactggagatcctcagattggatgggatactgatcagttccttactgacattggagaagcaactctggttatgctcagcgttgtcaggaatggaggactagcaccaggaggattcaacttcgacgcaaaattacgacgagagagtaccgatgtcgaagacttgttcatcgctcatatctcaggaatggatacattggcccgcggacttcgaaatgttgccaagctgcttgaggacggatcactaactgagcttgttcgtaaacggtatgagagcttcgacacagaaattggtgcccagatagaggctggaaaggctgattttgaagcacttgagaagaaggcaatggaatggggagaaccaaaggttggctctgcaaaacaggaattggctgaaatgcttttccaatcagcactatagaaagtagcttatgttgagtacagagctcttcttttcctttcaatttttcaagaatttcagtttccaacatcaaagtttctctctttctacaaacgaaggcattgctacatatataaaatgaagattgaggatattattttgggtttggtgtgcttaaaatgtgatcacacttgcagttattgctagtagtccccctacttgtcctgctgatcttggaaaggaatgtgccagtgatggtgaatggaagggggaattcttccctggcattcctgaaatcaagtatgagggtccttccagcaagaacccactttcgtttaaatggtacaatgcggaggaagagattcttggaaagaaaatgaaggattggatgagatttagtgttgccttttggcacactttccgtggaactggaggagacccttttggtgcacctaccaaggtctggccatgggaagacggtactaattcattggcaatggccaaaagaagaatgagagcaaactttgaatttattcggaagcttggtgtagatttatggtgctttcatgatagggacattgccccagatggaaaaaccttggaggagtccaatgcgaatttggatgaagtggtcgctttggcaaaagagcttcagggaaacaaaatccatcctttgtggggcacaaatgagttgttcatgcatcctcgctacatgcatggtgctgctactagctccgatgtaggtgtctatgcttatgccgcagcc

SEQ ID NO: 5854 - DNA, 753 bp, Artificial
  Synthetic
tcgcgaggaagcagggcctcacgaagtactcacctgtggagagcaaaaagcttttaacccatccactaccctcctctctctctctctcttctctctctccttgcgcataaacgaaatcaatggccgcactacaacaaactccgacagctttacagtgcaggtcaccgccgccgactcaaatcatcaccggacctacggcgaagctctcattttccggcggcctcaagctcccgaaactcacaatcaagctccgctctaatcgcacctcccgccgcggaggcggtgctgccggagcaaaaatggtggcttccgctgccggaagttacgcgaacgcactcgccgacgtagccaagtcgaatggaaccctagaacaaaccaccgccgacctcgaaaaaatcgaaaaaatcttcgacgacgaagcagtgtacaacttcttcgtgagccctatcgtcggagaagagaagaaacgcgaactcgtggacgagatcgtttcatcctcgagcatccagccgcacgtggcgaatttcctcaacattctggtagacatgaagcgcgtggagctaatcaaagaaatcgtgaaggagttcgagaaagtctacaatacacttacggacacggaacttgctgtggtcacttctgttgtgaaattggaatcgcagcatttggcgcagatagcgaaaggagtgcagcgattgacaggttcgaaaaacgtgagaattaaaacggctatcgatgaatcgctagtagctgggt

SEQ ID NO: 5855 - DNA, 849 bp, Artificial
  Synthetic
tctctctctctctcctagcgcataaacgagatcaatggcggcactacaacaaactccgattgctttccagtccagatcacccccgacaactcaaatcatcagcggaccgacggcgaagctctccttttccggcggcctcaagctcccgaaactcaccatcaagctccgctgtaatcgcacctcgcgccgcggcggcggtgctgccggagcaaaaatggtggcttccgctgccggaagttacgcgaacgcactcgccgacgtagccaagtcgaacggaactctagaacaaaccgtcgccgacctcgaaaaaatcgaaaaaatcttcgacgacgaagcagtgtacaacttcttcgtgagccctatcgtcggcgaagagaagaaacgcgaactcgtggacgagatcgtttcatcctcgagcatccagccgcacgtggcgaatttcctgaacattttagtagacatgaagcgagtggagctaatcaaagaaattgtaaaagagttcgagaaagtatacaatacgattacggacacggaacttgctgtggtcacttctgttgtgaaattggaatcgcagcatttggcgcagatagcgaaaggagtgcagcgattgacaggttcgaaaaatgtgaggattaaaacggctattgatgaatcgctagtagctggatttacaataaggtacggaaattcaggatcaaagttgattgatatgagtgtgaagaaacaacttgaggatattgctgctcaacttgaaattggggatattcaattagctgtataattgttctgtttttaaaattatattttttttcagggatttatttttgtaatataatttgcttcaaaggc

SEQ ID NO: 5856 - DNA, 401 bp, Artificial
  Synthetic
tctcttcaacgaactctattctctcttcaatccaaactcccaccatcctccttccaaatcgccagatctctcccactccgaaaaacctttccaatccgaatcaacaacggtggaaacgccgccggagcaagaatgtcagccaccgcagcatcaagctacgcgatggcattagcagacgtcgcgaaaagaaacgacacaatggaattaacagtcacagacatcgagaagctcgaacaagtcttctcagatacacaagtactaaacttcttcgcgaatccaacaatcaccgtcgagaagaaacgtcaagtcatcgacgacatagtgaaatcgtcgtctcttcaatctcacacatctaactttctcaacgtcctcgtcgacgcgaatcggatcaatatcgtgac

SEQ ID NO: 5857 - DNA, 689 bp, Artificial
  Synthetic
ttactcaccacgcgtcgatctaagtgtttgatcgatcgacactcaagcaatggatttgctccaaggctcgtcttcctcggcagtggcagcggcaacgcatcgcgccgcaagcatcgccgccactcgcgccagagccgcgacgctgtcgagctcgtcccggatctgctggaacgctctggcggccagagctcccgaggtaagaccacaacacagcagcagcagcaggggggtggtggtgatgggtgtggaggaatcgtatgcctcggcgctggcgaacctggccaaatccaaggacttgctcgacaccatctactccgacaccgagaagctggccaagtacttcgacaacccaaaggtggccaagttcttggccaacccggtggcggaggtggcgcgaaggaagtcactgatcaaggccatagctgacgaggagaagctccacgcatacaccaccaatctcctctacgtgctggtggacaagaggcgagtgggcattgccaaggacgtcttccaggcgtacgagacgagctactacaagctgaccgacaccgagatcgccgtggtcacctccgcggtgaagatcgaggactcgcagctggcggagatcgccaagaaaatccggagcttgtccaaggcgaagaacgtcaagatcaagaatgaggtggatgcgtcggtcattgccggattca

SEQ ID NO: 5858 - DNA, 195 bp, Artificial
  Synthetic
gaattccagctgaccaccatggatataaactcaaatgcctcgtcatctaattagtgacgcgcatgaatggattaacgagattcccactgtccctatctactatctagcgaaaccacagccaagggaacgggcttggcagaatcagcggggaaagaagactgaacaaactacttaacatggcaattcccggggatc

SEQ ID NO: 5859 - DNA, 552 bp, Artificial
  Synthetic
tcaaagcattgcggtggtccctgcggatgctaacgcaatgtgatatctgcccagtgctctgaatgtcaaagtgaagaagggcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactactttgaacgttatattacttattccgtgaggcggaagcggggcatcgcccctctttttagatccaaggctagcttgctatgccgatccgggcggaagacattgtcaggtttcaccccaccagagtgggacccaaacacaccatctccaatcttcggaggtagtactggtggattgtcgcgtaaagctcaagtagag

SEQ ID NO: 5860 - DNA, 100 bp, Artificial
  Synthetic
cgagaacagaaatctcgtgtggaacaaaagggtaaaagctcgtttgattctgattttcagtacgaatacgaaccgtgaaagcgtggcctatcgatccttt

SEQ ID NO: 5861 - DNA, 632 bp, Artificial
  Synthetic
gaattcaggtagaaggcccacgggtcatgaacttggttttcccggagaagaagcaatgacggtatctggggaataagcatcggctaactctgtgccagcagccgcggtaagacagaggatgcaagcgttatccggaatgattgggcgtaaagcgtctgtaggtggcttttcaagtccgctgtcaaatcccagggctcaaccctggacaggcggtggaaactaccaagctggagtacggtaggggcagagggaatttccggtggagcggtgaaatgcgtagagatcggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggcctcagctgctgaaggaaagacagaagctccagcgaaagaagccccagcaggtttcaccccaccagaattggacccaaacacaccatctccaatattcggaggtagtactggtggattgttgcgtaaagctcaagtagaggagttttacgtgatcacttgggattctcctaa

SEQ ID NO: 5862 - DNA, 1080 bp, Artificial
  Synthetic
gcccctgaacagacttccccacctgacaatgtcttccgcccggatcggcccgagggactcgggccttagagccaaaaggaggggccaggccccgcttccgactcacggaataagtaaaataacgttaaaagtagtggtatttcacttgcgcccgagggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcagcatccgcgaggaccatcgcaatgctttgttttaattaaacagtcggattccccttgtccgtaccagttctgagtcggctgttcgacgcccggggaaggcccccgagggggccgttcccggtccgtcccccggccggcacgcggcggcccgctctcgccgcgcgagcagctcgagcagtccgccggcagccgacgggttcggggccgggacccccgagcccagccctcagagccaatccttttcccgaagttacggatccgttttgccgacttcccttgcctacattgttccattggccagaggctgttcaccttggagacctgatgcggttatgagtacgaccgggcgtggacggtactcggtcctccggattttcaagggccgccgggggcgcaccggacaccgcgcgacgtgcggtgctcttccggccgctggaccctacctccggctgaaccgtttccagggttggcgggccgttaagcagaaaagataactcttcccgaggcccccgccggcgtctccggacttcctaacgtcgccgtcaaccgccacgtcccggctcgggaaatcttaacccgattccctttcggggcacgcgcgtggtcgcgctctctgccggggttaccc

SEQ ID NO: 5863 - DNA, 647 bp, Artificial; identical to SEQ ID NO: 4980
  Synthetic

SEQ ID NO: 5864 - DNA, 589 bp, Artificial; identical to SEQ ID NO: 5131
  Synthetic

SEQ ID NO: 5865 - DNA, 1257 bp, Artificial
  Synthetic
gaattcgaaaacaaaaacaacaatggcttcaacagcttcacacactactctatctctactcagaacaacagcatcatcttcatctgctcgcaacaaccgtgtatcatcaacattacaagttgcagcagcatctcgattgagaaacatcggattacaagttagaaacccaaaaagtcttgggttttctggtgttgcagtagatcctcttctttcatcacacgtttcttcacaaattggagctgttaatggtaaaggggtgagaggtgttgtttcaatggctaagaaaagtgttggggatttgagtgcatctgaattgaaaggtaaaagggtttttgttagggctgatttgaatgtcccgttggatgacaatcagaacattactgatgatactagaatccgtgctgctattccaactatcaaacatttgatggccaatggtgctaaagtcattcttaccagtcatttgggaagaccaaagggtgttactccaaaattcagcttggcccctcttgtccctaggctctccgagcttcttggcatcactgttgagaaagctgatgattgtattggccctgacgttgagaaattggttgctgcactaccagaaggtggtgttctccttcttgaaaatgtgagattctacaaagaggaagagaagaacgaaccagaattcgcaaagaaacttgcttccctcgcagacctatatgtcaacgatgcctttggaacagcacacagagctcatgcttcaactgagggagttaccaaatacttaaagccatctgttgctggtttcctcttgcagaaggaactggactatcttgttggggcagtttcatccccaaagagaccatttgctgccatcgttggtggttccaaggtgtcatctaagattggtgtgattgagtcgttgctagagaagtgtgatattctacttttgggtggaggtatgatcttcacattctacaaggcacaggggctatcagtaggttcttctcttgtggaggaagacaagcttgaacttgcaacctccctccttgagaaggccaaggcaaagggtgtgtcacttttgttacccagtgacgtagttattgccgataaatttgctgctgatgcaaacagcaagattgtacccgcatctgagatcccagatggttggatgggattggatattggcccagattctatcaagacattcaatgatgccttggacaccaccaagaccgttatctggaatggacctatgggagtttttgaaat

SEQ ID NO: 5866 - DNA, 716 bp, Artificial
  Synthetic
ttagtagtagacggccgccattcttcctcttcggttctatcgatcgatcgatccatcagccatggccgccgcaacagccgccgcatcgtcgcagctcctctcgccggcggcgtcgctgggctcggcggcgtcgccgtcgtcgtcgtcgtcgccttccggcaatcgcgccgggttcaggtcattggggaggcaatgcttcgcgggactcgtcgcggggcgccgggaggtgcggcggctgggggatttcgagcggcagcagccggatttcgcggcggcagtggcggcggcggtgaggtcgtcggggggcaatgggcgcggcagccgcggcgtggtgtgcatggccaagaagagtgtgggggatctcaaggaggcggacttgaaaggcaagcgtgtctttgtcagggctgatctcaacgttccactggatgccgatctaaacatcaccgacgatacgaggattcgtgctgccgtgccgacgatccagtatctcattggcaatggggctaaggtcatcctcagcagccatctggggcgtcccaaaggagtgaccgagaagtatcgacttacacctcttgttggaaggctctcagagctcttgggaaccaaggttgagaaggctgacgattccattggtcccgaagtcgagaagaaagttgctgctttgcccgatggtggactgctacttctcgagaatctgaggttttatcctgacgagg

SEQ ID NO: 5867 - DNA, 685 bp, Artificial
  Synthetic
gacgatggcatcggtgaagaaaagcgtgggcgatctcacggaaggcgacctcaaggtgcaagcgcgtcttcctgcgggccgatctcaacgtccccttggatgcggagttcaacatcaccgacgatacgaggctccgagccgcggtgccaacgatccagcacctccgccgctacggagccaagattatcctcgccagccaccttgggctgaccaaagggatacaccaagagctgccgccttgctcctctggtaggaaagcttacggagctgctcagtgtcaaggtagacaacaagaaaatccggtgcttttcgtgctaatgacgctgctgaaaaggttgacatcgccgattgattccgtgggtcctgaagtggaggcaaagatcgctgctctcggcgatggcgacgtgctgctgctggagaatctgcggttctatccggaggaggagaagaacgacgcggggcatgcaaaaaagctggcggcgctggcggatctctatgtcaacgatgcgtttggcaccgctcaccgggcgcatgcttccaccgaagggattacaaagtacttgaagccttctgtggctggatttctcatgcaaaaggaacttgactacttggtcggggcagtctcggaaccaaagcggcctttcgcggccattgtcggcggctcaaaagtctcgtccaagatcgg

SEQ ID NO: 5868 - DNA, 1390 bp, Artificial
  Synthetic
cttcactctgtcttcacactctctgcttttgccgtaggacagaatcgtcgagtttagtgacgaagactgtaatcaatggcatcagctacagcttctcacactttgtgcggcatccccgccacctcatcctctactaccaacaagtctattgccccttcatctgctcgcttcctctctaaaactcctctccgccgcctcggcttcgctggcgccgccgctgattctctcttcaccaaccacgtggcaaccaagctccgatccctcaagagctcctccaagcctgttaggggcgttgcttctatggccaagaaaagcgtcggagacctcaccgctgccgagttgaagggcaagaaagtcttcgtcagggccgatttgaatgtcccacttgatgatagccagaacattactgatgacactagaattagagctgccgtccctactatcaagcacttgatggccaatggtgctaaagttattctctccagtcacttgggacggccaaaaggagtcactcctaaatacagcttggcacccctagtccccaggctatccgaactgcttggaatccaggttgtgaaggctgaggactgcattggtccggaagtcgagaagttggttgcttcacttcccgagggtggtgttcttcttctcgagaacgtgagattctacaaggaggaagagaagaacgaacctgagtttgcaaagaaacttgcatcattggcagatctttacgtaaacgatgcatttggtacagctcacagagcacatgcctctacagagggagttactaaatttttgaagccttctgttgcaggtttcctcttacaaaaggaattggactatttagtcggggcagtttcaaatccaaagaggccatttgctgctattgtgggtggttcaaaagtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggagaaaggagtcagtctcttgttaccatctgatgttgtgattgcagataaatttgctcctgatgcaaacagcaagattgtgccgtcatctgctatcccagacggttggatggggttggacattggaccagactctgtcaagactttcaatgatgccttggataccacaaagacagtgatctggaatggacctatgggggtgtttgaatttgacaagtttgctgttggaacagaggcaattgcaaagaagctcgcggacttaagtggggaaggagtgacgactatcattggaggtggagattctgttgcagctgttg

SEQ ID NO: 5869 - DNA, 1182 bp, Artificial
  Synthetic
atttatacgatcctcgatccttccaattagtcacagacatcgttccgttcatcgtatcgatttttccgacggaaaaaactatagagaaatggcggtgaagaagagtgtgggatcactgaaagaagcagatctgaaggggaagagagtattcgtgagagttgatctgaacgttccattggatgacaactttaacatcactgatgacaccagaatcatagccgctgtacctaccgttaagtacttgatgcaacacggtgctcatgtcattcttgcctctcatcttggtcgccctaaaggtgttactccaaagtacagcttaaagccgcttgtgcctagactatcagaactattgggagttgaggtcaagatagcaaatgattcaattggtccagaagttgagaaattggtcgctgaaataccagaaggaggagttctgttgctggagaatgtcagattctataaagaagaggagaagaatgagcccgaatttgccaagaaattggcatctcttgcagatttgtacgtcaatgatgcatttgggactgctcatagagcccatgcttccacagaaggggtggctaagtacttgaaaccagctgttgcgggatttcttatgcaaaaggaacttgactatttagtaggagctgtggcaaatccccagaagccatttgctgccattgttggtggttcaaaagtatcatctaagattggtgttatagagtctctcttggagaaggttgacgtgttattacttggcggaggaatgatctttactttctacaaggcgcaagggtacgctgttggatcatcactagtggaggaggacaagcttgatttggcaacatctctcatggagaaggcaaaggcaaaaggggtatctctattgcttcccactgatgtagtgattgccgacaagtttgctgctgatgcgaacagtaaggttgttccagcatctgaaattcctgatggctggatgggattggatatcggacctgatgcaatcaagtcatttggcagcgccttggataccaccaagactgtcatttggaatggaccaatgggtgtgtttgagtttgacaagtttgctgctggaacagaggctattgcaaagaaactggcagagcttagtggaaagggagtgacaaccatcatagggggtggtgattctgtagctgcagttga

SEQ ID NO: 5870 - DNA, 589 bp, Artificial
  Synthetic
gaattctaaatcaattgatttaccgaagaacgtgagaataattttaatttaatcgattcatcaatattttctaagttgtaatatcttcaatggctacaattgggaacaacaatcttaatgcgaaacttgttttgcttggtgatatgggagcaggtaaatcaagtcttgttttgcgattcttcaaaggtcaatttctcgagtttcaggaatcaacaattggagcagcgtttttctcacagacgttggccgtgaatgatgcgactgttaaatttgagatttgggataccgctggtcaggagagatatcataacttggctcctatgtactacacaggagctgctgctgcaataattgtttacgacataactagcacggagtctttcacgcgtgcaaagaagtgggtgcaagaactacagaaacaaggtaatcccaacatggttatggcacttgctggaaataaagccgacttataagaaaaaaggaaagtgacagctgaggaagcacgtgtgtatgctgaatagaatggtcttttcttcatggagacctctgcaaagactgctatcaacgtcaacgacatattctatgaaat

SEQ ID NO: 5871 - DNA, 813 bp, Artificial
  Synthetic
ttttttttttttgtggagaaagaaaaaagcagcaacttatttaaagagaatcaaagtcaaggggaaccatagtacgactgcattacaactctcactatcccatcttaaaaaccaacttatactgcctgaaacaacagaaaccaacattgcaactttggaccccagttaaaaaaaatatcaaagaggaaagaaaaatcctaaggagtaacccttatgatttgtacaggccaccagaatactggcagattaaaaagaatatatctggcacaatacaaccaggagaaggcctgaaaagtgattctaactagaacagcaaccactcttctgggaaacaggtcgacctcgtatctggactgttggaggctttgcattattcgatgctggctggcttgccatcctattctttatgtcagctgccattgccatgaaggcctgctcaacataagtggcattctttgcactagtctccatgaatggaataccaatttcatcagcaaaagcctttgctgtatcataagacacagcacggttgtcagccaggtcacacttattcccaaccagaagcttgtttacattgtcacttgcataacgatcaatctcactcaaccattgcttaacattgttaaagctttcttggtcagttacatcataaactatctgccagaatcaccaaaatagtggttggaggaactattttacagagccagaaagaccaaatccacctgttaatagttctaaaaaggagagaagagaaacctacaatgatgccatgtgccccacggtagtaactactggtaatcgtcctgaagcgtt

SEQ ID NO: 5872 - DNA, 701 bp, Artificial
  Synthetic
ttatgtggatcgattcgtgagctacttactaggcgagaatcaaatggcactgtcttcctcctccgtcagcggcaacgagtttgatcacctcttcaagatactgctcgtcggggactcgggtgtcggcaagagcagcctgttgctgcgattcaccgccgacactttcgacgatctctcccccacaatcggtgtggatttcaagctcaagcttatgacgctggaaggcaagaggctcaagctcaccatctgggacacagccgggcaggaaaggtttagaacgcttacgagctcgtactaccgaggggcacaaggcgtcattcttgtttacgatgttacaagaagagatacgttcacgaatctctcggaagtttggctcaaggaggtcgagctctactccaccaaccaggactgcgtcaagctcttggtggggaacaaagtcgacagggattccgagcgtgcggtgacgaagcacgaaggcatggctttcgcccggaagtatggctgcctgttcctggagagcagtgccaagacgaagatcaacgtccaacaatgctttgaagagctggtcaggaagattctggaaactcccagcttggtagccgaggccaagtcggtgaagaaaaacatcatcagaccaagcaacgatgaggagccgcctgcagctggcgataactctggtagctgcgcgtgttgatagagag

SEQ ID NO: 5873 - DNA, 723 bp, Artificial
  Synthetic
ctcagtcgtgtcttgtcacttaattatctcgaccacgcgtcgggtggatctgggagatctagctcgcgaattggtcgcgcgatccgcgtagatagatctggagctgctccttggatgtggaatgccgtggtccaagcttttggggaataggtcgtgagcggcagcgcggcaaaataggtcttgatcgagagtgatttgcgagaaatgggtgtgccaaccgcgacggtgtcgccgctcgccaagtacaagcttgtgttcttgggcgatcaatcggtggggaagacgagcatcatcacgcgtttcatgtatgataagtttgacaacacgtaccaggcaaccattgggatcgacttcttgtcgaagaccatgtacctggaagatcgcactgttcgcttacagctctgggatactgctggccaggaacgttttcgcagcctaattcccagctacatacgggattcgtccgtggcggtggtcgtgtacgatgttgcgaatcgccagtcgttcctaaacacggccagatgggtggaagaagtccgcaccgagcgtggtagcgatgtgatcatcgttctcgtcgggaacaagaccgacttggttgacaaaaggcaagtctcgatcgaggagggggatgccaaagcccgggaatttggagtcatgtacatcgaaaccagtgccaaggccggattcaacatcaaggctctcttcagaaaaatcgctgccgca

SEQ ID NO: 5874 - DNA, 673 bp, Artificial
  Synthetic
  misc_feature (488)..(488): The residue at this position can be any nucleotide.
gaactgtcaagcctctgcctgctctcaccagatctgaagatttccgtcttaccttcattatgaatcctgaatatgactaccttttcaagattttattggttggtgactctggtgtggggaaatcatgtctcctcctccgatttgcggatgataattatgtggagagctatataagcaccattggtgtggattttaaaatccgaactgtggaactcgatggaaagactctgaaacttcagatttgggatacagcagggcaggagcgcttccgaaccattactagcagctactacagaggagcgcatggcattattattgtttatgatgtgacaaaccaggcaagcttcaataacgtgaagagatggttgaatgagatacagcgatatgcaagtgacagtgtgaacaaattgttggtagggaataagtgcgatatgaccgaaaagaaagccgtagataccgaaacggcaaaggcatttgctgatgagatnggcattccatttctggaaacaagtgcaaagagcgcgacaaatgttcaagaggctttcatcacaatggcgactgagataatgaaaaggatggcaagtcaaccctcagtaactagtacaaagcccaaatttgtccagattcaagggaaaccggttaaccaaaaaagaggctgctgctcttaatgcaa

SEQ ID NO: 5875 - DNA, 589 bp, Artificial
  Synthetic
gagagagagaaagggagaaagagagatgcaccgtctttccttcgacaaagcactctagatctgtgttttaggcagagagagagaaagagagagagagagaaaaaccagcgaccctttcgaaatccgttgattccttaagcgggggcccgggggcaggttgcggggtaactgatacttgctatcagggtttcttcggaacggcggggtggaagcatgtcctaccgatcggaagatgaatatgattaccttttcaaggtggtcttgattggggactccggggtcgggaagtccaacctcctctcccgatttacaaggaatgagtttagccttgagtccaagtcgacaattggcgtggagttcgccacgcggagcatcagcgtggatgggaagatgatcaaggcacagatttgggacaccgccggacaagaaaggtacagggccatcacaagtgcctactaccgtggagcagtgggagctctgttggtttatgacctcacccggcaggtgacattcagtaatgtacctcgatggctgaaggagctgagggaccacacagactcctcggtggtggtgatgctggtgggggaac

SEQ ID NO: 5876 - DNA, 689 bp, Artificial
  Synthetic
gagcaaggcctccagaggagagagatatatagtagagagagcgctggtgtgattagatcgccatagccggatcgagtgattgggatgaggaattcatagtttttcttccgggagagcaggttttggcagcgcaatgaagcctggaggatctcctttcaaagttgttcttctgggagacggtagagtcgggaagacttctctcgtcctgcggtacgtgaataatcacttctccgatagtcaaagtgctacgatacaggcttcctacttgaccaagcgcttgagcgtcgatggcactgtggcaacgctatcaatatgggatacagcaggccaggaacgcttccatgcattaggtccgatctactacagggacgctgatgctgcattgcttgtctatgacattatggataaagatagctttactcgtgtgaagaattgggtaaaggagctgcggaagatggcatccaacaagcacatcgtcctgacgatcgctggaaacaagagtgatatggacaagctgcggcaagttgatctccaggactctgagagatacgctgcgtcgattggagcaaaccatttcgtcacctctgcgaagctaaacagtgggatagacgacgctttcatggacatagctacacgttgcatggaacagagaagaaaggctgctgcggactctagcaatggcagcgtgc

SEQ ID NO: 5877 - DNA, 340 bp, Artificial
  Synthetic
cccacgcgtccgctctggctctgtatcgctcgctgctcttcctcccacagatcgaaaaccatgaatcctgagtacgactatcttttcaagctcctgcttatcggggattctggcgtaggcaagtcttgtcttcttttgagattctctgatgattcttatgtagaaagttacattagcactattggagtcgattttaaaattaggactgtggaacaagatggcaaaacaattaagctccaaatttgggacactgctggtcaagaacggttcaggactattactagcagttactaccgtggggcacatggaattattattgtctacgatgtcacagatgaag

SEQ ID NO: 5878 - DNA, 590 bp, Artificial
  Synthetic
accaaacacgcgcacacgcagccgagatcgagagcgagctacttgccctagcagcagcagcagcgaggagcgcgagggggcggcggcggcggcgtgcatggcgggggctccgtcgaggtcgcgcggcgacttcgaccacctcatcaagctcctcctcatcggcgacagcggagtaggaaagagttgcttgcttctgaggttctcagatgacactttcactacaagttttatcaccaccattggcattgatttcaaggttcggacagttgagcttgatggaaagcgtgtaaaattgcagatttgggatactgctggtcaagaacgtttccggacaattacaactgcctactatagaggtgctatgggcattctgcttgtttatgatgttacagacgagtcatccttcaacaacattagaaatgggatccgcaacatagaacaacatgcatctgataatgtcaacaagattttggtgggcaacaaggttgatatggatacaaagcgggtggtgtccacagctcaaggacaaaagctcgcacatgagtatggaatgaaattttttgagacgagtgcaaaaacaaatcagaacg

SEQ ID NO: 5879 - DNA, 605 bp, Artificial
  Synthetic
cccccgagcaactcatctcatcttcagagaagcaaagccaacaaaaagaaaaagaattttcaggttttcttctcgctttcaccggagaaggagaaagagaggaaggtgttgatcgaatcctcctccaatcgcgcgcgattcgatccccgttgctggctcgctcgctccgccgatccctcatccgatctgaatccccgatctgatggcggccaaccccggcaacaagatccgcaacgccaagctggttcttcttggagatgtgggcacgggcaagtcgagcctcgttctccggtttgtgaagggccagtttgttgagttccaggagtccaccatcggcgcggccttcttctcgcagaccttggcggttaacgacgagacggtgaagttcgaaatctgggatactgcagggcaggagaggtatcatagcttggctccgatgtactatcgtggtgcggctgccgcaatagttgtctacgacatcacaaatgcggcctctttcacacgtgcaaaaaaatgggttcaagaacttcaagcgcaaggaaacccaaacacgataatggctcttgctggtaacaaggctgatatggtacaggcgaggcaggtgc

SEQ ID NO: 5880 - DNA, 765 bp, Artificial
  Synthetic
gagccaaccatccgcttcgattgccactttgaccaaacctgcacctctttcaactctcaagccttccgcttctatttctcccgttccaacacaaacaccaacaaccgccatcatgaaccccgaatacgactatctcttcaagctcctcctcatcggtgattccggtgttggaaagtcttgcttgctgctgcgatttgccgatgacacctacaccgagtcttacatctccaccatcggtgtcgatttcaagatccgaacgatagaactcgatggcaagaccgtgaagctgcagatctgggataccgccggccaggagcgtttccgaaccatcacctcgtcttactaccgcggtgctcacggcatctgcgtcgtctacgatgtcactgatatggactccttcaacaacgtcaagcagtggctccaggagattgaccggtatgccaccgagggcgtcaacaagttgctcgtaggcaacaagagcgatatgtccgataagaaggttgtcgagtacaccgttgccaaggaattcgctgacagcctgggcatcccattcctcgagacttccgccaagaacgccagcaacgttgagcaggctttcctcaccatggctcgccagatcaaggagcgcatgggcaccacgactgccaacaacacgaaacccagcgtgcacgttggcccagggccagggtgtcggcaactcttccaacagcagctgctgttaaatgtattcctctttgatggtttcgtgtggttcgctttgtcgtg

SEQ ID NO: 5881 - DNA, 662 bp, Artificial
  Synthetic
gagcaacgttggcgaatccacgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattttcgctggtttttcttgatctcttcctcggttctgcgaagaagacgcatcggcagcaatgaatcccgagtaggtttcgattcgcgagcgattgacctcgccctctttgcagtgactatctcttcaaactcctcctaattggcgactctggcgtcgggaaatcgtgcctgctgctacgattcgcggatgattcttaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcag

SEQ ID NO: 5882 - DNA, 560 bp, Artificial
  Synthetic
aaattttcgaagggggaaaaaaaggtctatcgttcttgttcgcagcggcggcgttcgctttgatctggttctcgatcgatcgacccatcgattgtttcgcggcgatggcgacgacggggatccacatgcaggccaagcttgtgctgctgggcgacatgggagctggcaagtccagtctggttcttagattcgtcaagggccagttcttcgattaccaggaatcgacaattggagctgcattcttgacgcagacattggccgtgaacgagacgacggtaaagttcgagatttgggacactgcgggtcaagaacgctaccacagcttggctccaatgtactaccgcggcgctgccgccgccatcattgtttatgacatcactaacgcggactcttttgcaaaagcaaaaacatgggtacaggaactccaaaggcaaggaagtgccaacctcgtcatggctcttgcggggaaacaaagctgatttggctgcaaagcgcaagattgaaacacaggagggacaatcttatgcggatgaaaacgggctcttcttcatggagacttc

SEQ ID NO: 5883 - DNA, 601 bp, Artificial
  Synthetic
cccccgccagtgtctccccactccatagtgacactgcgccgggctgcgagatccaaaatccgaccagccagcgttagctcggagaggcgaggcgagaatgtcggccgcggcgggcgggtacagggcggaggacgactacgactacctgttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtatcgtgctatcactagtgcctattaccggggagctgtgggagcattgctcgtctacgatgtcacccgtcgtgctacattcgacaacgtgggacgctggctaagggagcttagagaccacactgatcctagcattgtctgcatgctgattggcaacaaatccgatctccgccacttggtggctgtctcaaccgaggacggcaaagagtttgctgaagccgaatcaatgtacttcatggaaacttctgcgctcgacgctaccaacgtcgac

SEQ ID NO: 5884 - DNA, 619 bp, Artificial
  Synthetic
gcaaatacgatgaataccgaatacgactacctcttcaagctgcttctcattggagattctggtgttggcaagtcttgtcttctgcttcgattcgccgacgatacctacactgactcttacatttccactatcggtgttgattttaagatcagaactttagagctggaaggaaagaccgtcaagctgcagatttgggatactgccggacaggagcgtttccgaaccatcacttcttcatactaccgaggagcccacggtatcattgtcgtctacgatgtgactgaccaggacacattcaacaacgtcaagacttggttccacgagattgaccgatacgccaccgagggcgtcaacaagctgcttgtgggtaacaagtccgatatcaccgacaagaaggtcgtagagtacactgtggccaaggagtttgccgactctctgggcatccctttcctggagacctcggctaagaacgccaccaacgttgagcaggcatttttgaccatggcacgtcagatcaaggagcgaatgggcggagctgccgagaacaccgccgccaaggccaatgtcaacctccgaggccagaatgtctctcaaggttccagcagctcttgctgttaac

SEQ ID NO: 5885 - DNA, 704 bp, Artificial
  Synthetic
gtgaaacagcaaaaaaaatcaaacaaaaagaaaaaaaattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctcctagatctgtgctgttccccttctcctttcgccagtatcagtcgtcttgagtcgtcgagtccctaaataacgaggaggtggtggtggtgttagtctttttatgagttcgt

SEQ ID NO: 5886 - DNA, 639 bp, Artificial
  Synthetic
aacaactttgcgactcctcgattttattcacagcccgccaaaatgcctaacaccaaggttttcttcgacattgcctggaagggccccgtcttcaaggacggccgtcctacctccgagatcaaggagcagaccggtcgcatcaacttcaacctctatgacgacgttgtccccaagaccgctgagaacttccgtgctctctgcaccggcgagaagggcttcggctaccagggctcttctttccaccgaatcatccccaacttcatgctccagggtggtgacttcacccgcggtaacggcactggcggcaagtccatctacggcgagaagtttgccgatgagaacttccagctgaagcacgaccgccccggtctgctgtccatggccaacgccggccccaacaccaacggctctcagttcttcatcaccaccgtcgtcacctcttggttgaacggccgccacgtcgtcttcggcgaggtcgctgaccaggagtccatggccattgttgctgctcttgaggccaccggccgtgatgacggcaaggtcaagtacgagccccgccccaccatcaccgcctccggtgtcctgtaaacttgttgaaaagaagcaacatgctctgcatgtccatttggtggcagtttt

SEQ ID NO: 5887 - DNA, 638 bp, Artificial
  Synthetic
agcgtcgcaggtaatggcggctacaggcaagctttgcgcaaccatgccgggtatggccgccgccgccgcggcctctcgggcatggctccgctctccttcatccatcctctcgccgccgccgcagcagcaccagctgctcctcaagacgattgctcctagccaccgccgccgctctttcgccacccaggccgcagtgagcgtggagcagccgcctctgcaagccaaagtcaccaggagatgcttcttcgacatgaagattggcaacgaacctgtgggccgtattgtcattggtctcttcggcgaggacgttcccaagaccgtggagaacttccgcgctttgtgcgcaggtgacagagggtatggctacaggggctctgccttccacagggtgatcaagaacttcatgatccagggaggtgatttcgatcgatgtgatggaactggaggcaggagcatctacggtgggaagtttgaggatgagaacttcaagctgtgtcacaccgggccaggagttctcagcatggccaatgcaggtcccaataccaacggcagccagttcttcctctgcaccgtcaagaccgagtggctggacaagaagcacgtcgtcttcggtcatgtcctcgaaggcatggacgtag

SEQ ID NO: 5888 - DNA, 483 bp, Artificial
  Synthetic
ccacgcgtcgtggaaggagagagagagagagagagaaagagaaacagaaagagagagagagagagggaggagaagtcttcctagccatggccgcctcgcagtttctaaccctgggtagagttggacatcccataactactgggaatcatgttcaatgtagtccaatcatgtcacgaatgccaatgcggtctgcttctatcaaaaataccccctgtttattaaagatgaggtctgtcaagcttgcttattgtaatgtggcaagaaaacagctctccgtgacgtgcacagctcaagaagttggggcagtagcaaaggttacaactaagtgcttctttgacattacaattggaggagatcctgctggaagaatcgtgattggcctatatggtgacgatgtgccagaaacagtggagaacttccgagcgctctgcactggagagaaagggtttggatatcaaggctctgcatttcatcgcgtcatta

SEQ ID NO: 5889 - DNA, 686 bp, Artificial
  Synthetic
tgcggacgctgtgggaaattttctgcccttgcaagcgctcgtctttctccgtcgtcgttttccggtgaacagctgtttaggaatggcgaacccccgtgtgttttttgacatcaccatcggcggcaaccctgcaggccgcatcataatggagttgtatgcggacaaggttccaaggacagcggagaacttccgtgccctctgcacaggggagaagggaattggaaagagtgggaagccactccactacaagggtagctccttccacagggttatcaacgacttcatgtgccagggtggtgatttcacgcggggggatggaacaggtggagagtccatctacggggccaagtttgccgatgagaacttttcgtgcaagcacactggtccaggcatcctctccatggccaatgcaggaccaaacaccaatggctcccagttcttcctttgcaccgtcccctgtgcatggcttgatggaaagcatgttgtcttcggcaaggtcgaaaatggaatggacgttgtcaagactattgagaaatacggatctgggagcggcaagacgaaagcccctgttgtcgttgctgactgtggccagctctcttgaagtatggttggtggctccccttagaagaataacctcttccccccctctaataagttttggagcctattcttcgctaagctttata

SEQ ID NO: 5890 - DNA, 1145 bp, Artificial
  Synthetic
cggacgcgtgggcggacgcgtgggcaaaaactccattgaagagaggcctacatttcctctttctctctctcctattttactctctctctctctctagccatggctttgctcgttgagaaaaccacctctggccgtgagtacaaggtcaaggacatgtctcaggctgacttcggtaggctcgaaatcgagcttgccgaagtcgaaatgcctggtcttatggcttgccgtaccgaatttggtccgtcacagccatttaaaggcgctaaaattaccggatctctacacatgaccattcaaaccgctgtccttatcgaaaccctaactgctttaggcgctgaagttagatggtgctcttgcaacattttctctacccaggaccacgccgccgctgccattgcgcgtgacagcgctgccgtgtttgcgtggaagggcgagacgttgcaagagtactggtggtgtactgaacgcgcccttgattggggcccgggtggtggaccagatttgattgttgatgatggtggtgatgctacacttttgattcatgaaggtgtaaaagctgaagaggaatatgctaaatctggtaaattaccagatccaagttctactgataatgctgagtttcagcttgtgcttactattattagggatgggttgaaaactgatcctttaaaatacactaagatgaaggagagacttgttggtgtttctgaggaaactactactggtgttaagagactttttaaatgcaagctaatggaactttgcttttccctgctattaatgttaatgactctgttaccaagagcaagtttgataacttgtatggatgccgccactcacttcccgatggtctcatgagggctactgatgttatgattgccggacaggttgcgcttgttgccggttacggagatgttggcaagggttgtgctgctgctttgaagcaagctggtgcacgtgtgatcgtaaccgagattgatccaatctgtgctctccaggctaccatggaaggtcttcaggtccttacccttgaggatgtcgtttcagatgttgatatctttgttaccacaaccggtaacaaggacatcatcatggttgaccacatgaggaagatgaagaacaacgccattgtctgcaacattggt

SEQ ID NO: 5891 - DNA, 676 bp, Artificial
  Synthetic
agcagcagcagcagcagccagatgctgctgccatgtcgagtgctgctccgccacctttcctcacaaagacgtatgatatgatcgacgatccaggcagcgatgccatcgtctcgtggacagccaaaggcaacagcttcgtcgtgtggaacccgctcgacttctccagagatttgctcccaaagtacttcaagcacaacaatttctccagctttgtgcgtcagctcaacacctatggatttcgcaaggtggatcccgaccgctgcgagtttgccaacgaaggcttccgccgaggtgagagaaatctcctcaagaacatccacaggaagaagccgacggctcaaggccagtcgtcacagcaccacccgggaggacaacccggcgaggttgggaagctcggcctggaaggagaagtggaaaggctcaaccgggacaagaatgtactcatgctggagcttgtccggctgaggcagcagcagcagcagacggagagagagctccaggtcatgggacagaggctgcatggaaccgagcaaaggcagcaacacatgatatccttcatggccaaagccatccagaacccgggcttcttgtccagcttagttcaccaacgtaatggcgaaggtggtggtggatcgtatctaccgggcaagaggagaaagttggagctgtgcgatca

SEQ ID NO: 5892 - DNA, 746 bp, Artificial
  Synthetic
cccacgcgtcgggaatgccgtccgcactacagactcggacgatgatggacacggcaatgcgaatgtatcgtctactgcatcgtctcgtgattgtgcagcggcagcagccggatctccgcctcccttcctcaccaaggcatacgatatgattgacgacatttcctcggacccagttgtgtcttggagcaacagaggcaccagtttcgtggtctggaatccaccggagtttgcacgggatctgctgccccagtatttcaagcacagcaacttctccagttttgtgcgtcagctcaacacctatggtttccggaaagtcgacccggatcgatgggagtttgcaaacgaggagttcgtccgtggcaagaagagcctgctcataaacatatctaggaagaaaccgtcctcgcagcaacagccgcagcgacatcaccagagagcagcctcaagtgagtcaacgcttggtttggaagcagaggttgagagactcaatcgggataagaacgttttagtgctggagcttgtgaggctgaggcagcagcagcagcaggcggagagagagctgctggtcatgggccaacgcgtgcaaggatcagagcagaggcagaagcacatgatatccttcctggcgaaggctatacaaagcccacgatttctgtcacaagtccttcaacgcgagggcagtaactgttcgagcatcgccagccacaagaaacgaaagcagctggaggtttcggacgactttcgcg

SEQ ID NO: 5893 - DNA, 740 bp, Artificial
  Synthetic
agcatctcctcggcggcggcggcatcggcgcctagatctagctccatctcccggcagcaacaaggatagaaatggctctctccgtggagaagaccgccgctggccgcgagtacaaggtcaaggacatgtcccaggccgactttggacggctggagatcgagctagcggaggtggagatgcccggcctcatggcctgccggaccgagtttggcccgtcccagccgttcaagggtgcccgaatcaccggctctctccacatgaccatccagacggccgtgttgatcgagaccctgaccgctctaggggccgaggtacgctggtgctcgtgtaacatcttctccacccaggaccacgccgccgccgccatcgcccgcgacagcgccgcggtcttcgcctggaaaggcgagaacttgcaagagtattggtggtgtaccgagcgagctctcgactggggagttggcggcggtccggatcttatcgtggacgatggcggcgacgcgactttgctcatccatgagggtgtcaaggccgagaaggagtacgagaagaatgggacgctgccggatccgagctcgacggccaaccaggagttccagatcgtgctggggatactcaaggatggtatgcaggctgacccgaagaagtaccataagatgatggagaggcttgttggtgtttcggaggagactaccaccggtgtcaagaggctgtaccagatgcagtcgaatggatcgctgctc

SEQ ID NO: 5894 - DNA, 558 bp, Artificial
  Synthetic
cgttatttattatgcatcttgactacccctcgacccacgcgtccgtcttcatcagccctttgccaattacatattctctcaccgcctcctcgaaattctctagtgtctcgtgcgtaacttctgcttctcagtctgtatagaatcccagagtaccttcagaagatccgcgtccgatatttaggggccaaaaatggaagcaattcacgagataggaaattcgccaccgccttttctgtgcaagacgtatgatatggtggacgatttgtcgacggattcagtggtatcgtggagtaagagtaataacagcttcgtcgtctggaacgtgctggagttttcgagagatattttgcccaagtattttaagcacaataatttctccagctttgttaggcagttgaatacttatggttacaggaaggttgatccagactgctgggaatttgcaaacgagggattccttagaggccacaaacacctcttgaagaccataagtaggcgaaaaccgtctcaaatgcaggtccatcaggacaccgcctcccaagtgcaaagtgtatctgc

SEQ ID NO: 5895 - DNA, 844 bp, Artificial
  Synthetic
caagaacattctcagcttctagaaggttttctcaccaacccccaaattatgagaaaattacgaaattggctaaccaactacaaaagaatgattcaattcaccaaacgaattaaatgaagcattaaattgagagtaaatgagttttcgttagagtgaaactcacgtaagtgttgagctgacgaatgaagcttgagaaattattatgcttgaagtattgaggaagaagatctttagcaaactctgctgttttccacacgacaaaagctgttccttcttcgttccatgaaacgacgtcgtctgtgctatgatcatcaactagctgatacgttttgcttaaaaacggcgccggaactgatctttgcgccgccgtcacagccgtcatctccggcgaactttttttattttaccacagaaaaataaaactaaaaataatctaatacacaaagagaagaagaaagattggaaatagaaagtcgaaggaaaaagaatcagcaactaaaaagcaagagagcggtgagaaattcccaatcccagcaataaaagccagagaggaaaacacgagaacggagaagatcggagtttcgtttggtttcttccatttaaggaaaaatctgatgatggaggaagaagatgaagacgacgaccatacttcgccggagctaatccgtgtgattaaaaagtaaataaatataaagtcttttttatttttgtgtgtatgtgcaaaacacgtaaaacaaatatataaacgagttaagtgttatgtcgaacggtctctatataacgtagtaggaagatttatagatcacaaatgttggtcctacctttgtaagacaattaaattata

SEQ ID NO: 5896 - DNA, 687 bp, Artificial
  Synthetic
gcagcatgggaacggtttgcgaatctgtagcgacggcgaaatcttcgacggcggtgatgagctccattccgccttttctgagcaaaacgtacgatatggttgacgatccattgacggacgacgtggtgtcttggagcagcggaaacaacagcttcgtggtttggaacgtgcctgagttcgccaaacagtttctaccaaagtatttcaagcacaacaatttctccagcttcgtcagacagctcaatacttatggttttagaaaagttgatccaggccgctgggagtttgcaaacgagggctttttaagaggccaaaagcaaatactaaagagtattgtccggcgaaaacctgcacaagtgcagcctccacaacaacctcaagttcagcactcatctgtgggtgcgtgcgttgaagtgggcaaatttggactcgaagaggaagtggaaagacttcagcgcgataagaacgtccttatgcaggaacttgtaaggttgaggcagcaacaacaagttaccgaacatcatctgcagaatgtggggcagaaagttcatgtgatggagcagaggcagcaacagatgatgtcctttctagcaaaggctgtccaaagtccaggtttcttaaaccaattttctcagcagagtaatgaagcaaaccaacacatttctgaaagcaacaaaaagaggaggc

SEQ ID NO: 5897 - DNA, 566 bp, Artificial
  Synthetic
acgtcgatgcgtaggccctgatcgatctctactggtttcgagatcttcgaagaatcgtgatgggtatgacgctggtgctgctcaaatccttgctgccttatctcggaccggctgtaatgctcggctatccactgtatcaatcaatcaaagctattgagagcccttttaaagacgatgacgaacaatggcttacttactgggttgtatattcgtttatagctctcttcgagctagcagcagagaaagttctggatctcattccattctggcctccattgaagctactcttaatttgctggctggttctgccacagtttcggggtgcttgtttcctctacagaaactacgtgaggacatttgtcttgaacttcttgcagcaacatcaggatcatctcgacgacgatcataagcacgactacagcgagaagcagaaggagttgctccgaatgatgagcactgacgcccgagtagctgttgctcagtacatttccgagcatggaccggatgcattcgacaaactcatcaccactgctacaagacagtctgcaaagagcaaaacctcgccg

SEQ ID NO: 5898 - DNA, 819 bp, Artificial
  Synthetic
ggcaagaagtctctcaaactttactcttctctgaacaacaaagcagcaactcttaggatcctcatcagccactgacccaaatctagacccatcttcttctgtactctgctataactgcaaatctcagactatacctctctttagaagtcataatataattaattttggagtttacagtatgggaggatctggtggtgtaggaagcttcctcaaggttatactcaacaactttgacattcttgctgggcctgtcgttagtctggtttatcctttgtatgcctcaataagggctatagagagcaaatctcctgtggatgatcagcaatggcttacatattggattttgtactctatgattacactttttgagctgacctttgccaagcttattgaatggctccctttctggtcatatgcaaaactgatcacaacctgctggttggtcataccttactttaatggtgcagcatatgtgtatgagcattatgttaggccttatatcatccaacgaaaagcagttaacatctggtatgtgccacgaaagaaggatgtctttagtaagcctgatgacatcctaactgctgcagagaaatatatacaagaacacggaacccaagcatttgaggagatgatccacaaggctgaaggagaacgaaggccccaaaccagcaattatgtgttttatgatgacgactacagatactgaaccttgtatactacagtttctttggtttggtttttgctcctccagtactttaggaaaggaagagatctatctgctgttgtaaagaggtgccctaaaactgatggtttggcctt

SEQ ID NO: 5899 - DNA, 546 bp, Artificial
  Synthetic
tttggttaggcctttgtctctctctctctgctttacagtttccggaaggccatagctgctgtcagatcgttccactctctaggagttcatggctctacatttgttacatgggaccttccacatcactatctgcgaggcttcagggctaccgaagcaccatgctgggttcttacatagaatcgtgggacttggagggtcgcaacaactatatgcgaccatagatatggagagggcgagggtgggtcggacaaggatgattgatcacgagcctacaaatccctcctggaacgaaagcttccacgtctactgcgcctaccatgtgtcccatgtagtggtgagtatcaaggatgacaatgcagtgggtgcggcaatcgtgggaagagcaaagatccccgtggaagatattttaggcggggaggagattgaccagacctatggcctcgtcaaagacaatggggaggtagtggaagatgctaccatccatcttcgcatgcaatacttcgatatatgcaagttcccatggtggggcaagggtgtgagggggag

SEQ ID NO: 5900 - DNA, 549 bp, Artificial
  Synthetic
aaaaggatatgctttttgtgtgtaccaggatgtgtctgttactgatattgcttgtgcagcgcttaatggaattaagatgggcgataaaactcttactgttaggcgtgctaaccagggcacaacacaacccaaccctgagcaagagagtgtattgttgcacgcacaacagcagatagctttgcagagattcatgttacaacctggtgcattagcaacgaaggtcttgtgcttgactgaagttgtcactgtggatgagctcaatgatgatgatgactatcaagatattttggaagatatgaggactgagtgtgagaaattcggagctctagtgaatgttgtcattccacgtccaaatcctaatggtgtgcctacacctggactaggaaaggtatttttggagtatgcagatgttgacagttccagcaaagctcggcaaggactgaatggaagaaaattcggtggtaaccaagtggtagctgtcttctactcggagaacaagttctctgagggagactatgaggcttagctctaaccactaaagttatgata

SEQ ID NO: 5901 - DNA, 649 bp, Artificial
  Synthetic
gttggtgttggtgtatagtggagatggcaatggaagggggggacaagggaggaatccaaaggcttcttgcagcagagcaggaggctcaacatatcgttgcagctgcaagattagcaaaggcaacgaggttaaaacaagcgaaagaggaggctgaaagagaagttgctgcttatcgagctcagcgagaaagtgaattcagaaaaaggcttgctgatacaagtggagattctggtttaaacatcaagagattagaagcagaaacccactcaaagatagaacagcttaaagaggaagcagcgaatgtttcacctgaggttgtggaaatgatgataaaatatgtaacaaatgtcagaaattgatttgaccttggcttcagtttaccctaaagtttaaagcttttagcaggaagttcaataggtataattggtatttgttttgtatcagtgtttatgaatatgcaccataaggttgaaactagaagtttgtggacctgctagagaactatttttgtctaccatcgaactcgagtttctgctatgtccgattgtaaaggagatcattgatttgaagtttgtgacgagcacttcgatgtacactatttatggtcatgtaagtgaatgactatggtttagtatagttatgtaatgga

SEQ ID NO: 5902 - DNA, 671 bp, Artificial
  Synthetic
ggggaaaaagagactcttttcttgaggggtgcttttttcattgtttttcatcatcgtcacgagagagagaggagagggagagggagagggagagagagaggcagagagagagagagagagagagagagagtggcgatggcttctgaccagggaggaatccagaagcttttggctgcagagcaggaagcccagcagatcatttcctctgctagatcagctaaggcaactagactgaaacaagcaaaagaagaagctgagagagaagttggtgcttatcgtgcacaacgtgaaagtgaatttcgaaaaagattggctgagacaagtggagattctggttccaacatcaagaggctagaagctgaaacgcatacaaaaattcatcatcttaaacatgaatcggcacatatatctcctgaggtggtggcgatgcttattaactacgtcacgactgtaaaaaattgagggagggaatattttgagggggaggaacttgctatgaaactcttatcaaaaacctataattttttatttgttcaccattttgagatgtagaaaaatttgcctgtcatccaagcttttaggatttgtatgctaattgcaggaaatgggtgtcggcaatgagtaaataaattgatctttttcatatgtagtgaaaatgacaattttagtgc

SEQ ID NO: 5903 - DNA, 645 bp, Artificial
  Synthetic
atctttcgcagcaacggattctcaactccgattctacagagtgttatagacgagtatggcatctagcagtggccagaatggaattcaactccttttagctgccgaacaggaagcccaacacattgtcaatacagccaggactgctaaacaggctagattgaagcaggccaaggaagaagctgagaaggagatagctgaatttcgtgcttacatggaggctgagtttcagagaaagcttgaacagactagtggtgactcgggcgctaatgtcaaacgtcttgagcaagaaacagatgcaaagatcgagcacctgaaaactgaagcagaaagagtctcccctgatgttgtccagatgctcctgaggcacgtaaccacagtgaagaactaagatcttctgtgggtgtagtggatcaagcttaatgttcattttgcagatttatgcttccccctggtttatggtttctcttgcttgatcagtccaatggatgttctccatttatattttatttttattatcattatttattgtcttgtctgttgaataaaacaactcactcggagctcctttcaacctgtgttgtaaacttagatgagaaaccaaggtcagatgactaggcatggctgcttcttatttatgtagaactg

SEQ ID NO: 5904 - DNA, 408 bp, Artificial
  Synthetic
cccctcccttgctttatcgctagccacaaattctctcctgggtcctgcatggctgaaacctgcaaccccaacacccctttgagaattgacacgcgcgcagaagaaggaagatggatgctaccagacgccaaggaggaattcatcaattattggctgcaaagcaagaagctcaacagattgttaatgctgctaggagcggcaaaagaggaggttgaaagagaaatagttgattaccgagctcaaatggaagctgagttccataggaaggttgtggaaagtaacggtgattctggggcaaacgtaaaacggtttgagcaagaaactgacactataattgcccaactgaaggagcaggttgcaaatgtttcccctgaagtgatccagatgcttcttaggcatgtaaccacc

SEQ ID NO: 5905 - DNA, 580 bp, Artificial
  Synthetic
acgttttgagagagagagagagagagagaggggggcaaggagagagaaagcaagagaaagacagtagtgggagagagagagagagagagagagagagagagagatggcgacgagttcagagcaaggaggaatccaattgcttctgagtgcagagcaggaatcacaagagatcttagcctccgccagatcagctaaggcaactagattgagacaagcaaaagaagaagcggagagagaagttggtgcttatcgtgcacatcgtgaaagtgaatttcacaaaaagctagcggagactagtggagattcaggctccaacatcaagaggctagaggctgaaactcattcgaaaattcaccatcttactcatgaatcagcaaaaatatcccctgaggtggtcgggatgctcattaactatgtgacaatggtgaaaaattgaagccgaagatttcaacaaaacttgacacacaacacactggaatattgtttgatgaatctatgatatttttccccattcgctcacagccatttgcaatgtagaaatttagtctgctgtccaagcttttaggatattcatgaatgc

SEQ ID NO: 5906 - DNA, 492 bp, Artificial
  Synthetic
cccacgcgtccgaaacaaagacttttgtgcaataaagcatggaatccaacagaggtcaaggttcgatccaacagttgcttgctgctgaggtagaagctcaacacattgtcaatgctgcaaggaccgcaaaaatggcaagactgaagcaagctaaggaagaggcagagaaagagattgccgaatacaaagctcaaacagagcaagacttccagaggaaacttgaggagacaagcggagactctggtgcgaatgtgaagaggctggagcaagagactgataccaaaatcgagcagttgaagaacgaagcatcgaggatttccaaagatgttgtcgaaatgcttctgaaacatgtgaccacagtgaagaactgagagatatttttataagaaagtaaaaaaaaagtttatgaaaaaagtgggagtcatttttgagtgatctgctctctttctcttttgtgggtatttctggatttgagagactcatcttatatta

SEQ ID NO: 5907 - DNA, 65 bp, Artificial
  Synthetic
ggtaaatattatcctttcatgtatcatttgaacaaaataatgggagattctttttgtttattctc

SEQ ID NO: 5908 - DNA, 652 bp, Artificial
  Synthetic
gatcgatctcgtcgtcggcgatggagaagttgctttcctcctccggcgccgccgccgccgtggcgtcgcagggccagctcccggactgcttcgtgttcccggccgaccggcgcccaccggcctccaccgcggccgtgtcgctccccgtcatcgacctctccggcccccgcgacgccgtccgccgcgccgtcctcgacgccggcaaggagctcggcttcttccaggtggtgaaccacggcgtgccgccggagacgatgcgggagatggcggcggtgtgcgaggagttcttccggctgccggcggaggacaaggcggcgttctactccgacgcggaggagaaccccaaccgcctcttctccagcaccatctacgaggtcggcgaccagcgctactggcgcgactgcctccgcctcgcctgcggcttccccgtcgccgacgacaccaacacccactggcccgacaagccccaccatctccgggatgtcacggagaagttcttcgtggcgacgaggggattggggatcgagctgctgcggctgctgtgcgaggggatggggctcaggccggactacttcgagcgcgacctcaccgccggcgatgtcatcatcaacgtcaaccactaccctccatgcccggatccgagcctgacgct

SEQ ID NO: 5909 - DNA, 684 bp, Artificial
  Synthetic
gattcacaatggcagcccaaggacatgcttggaatacggcagccggagtgaaggggctctctgaagacggagcgtctgtgccaagcaaatttgtatggcctttagattccagagtcaagaaagaagagttttgcttacttgaaggcattccgctcatcgatttgtctcagtcgaatgtgaatactgtggaggaggtagccaacgcagctcaaaattggggattctttcaggttgataagcatgacgttcctgttgaactcatggaatctatgctcagtgttagtcgtgagttcttcaatatgccatcagaagacaagatggcctactactcggaagacttcaagtcgcctgtaggctatggcagtagctacagtccgtccggcgaaaatcaccttgagtggcacgaccatctgcttcactggttcccttcgttggaagagagccacccatggcctgagaaaccagcttcgtacaggaaaatagctgagaattatttggagcatgtctcgatgttggcaaagcagattgcggcattgctctccgaaggcttaggactggagcctggatatttatacgaggcgatgaaaagccctcaagtctatttgaggctaaactattatccaccgtgcaccaagtcagaacttgtgcttgggcaaacatcacactgtgactatggagtcttca

SEQ ID NO: 5910 - DNA, 797 bp, Artificial
  Synthetic
actgggaaatggcgatagttttaggaacaatgccgactcagggagtgaaggagctagtggagaattctcaagatcatataccagataagtatatcaagcccgagcgtgcccgtgttagatacaacagttccacagcagggattcccctcattgacctcgctgaaatccatggacaaggaagaagtgatgttcttcgtgccataagagatgcggcaggagagtggggattcttccaggtgatcaatcacagcgttccaccagctttgatggaggctatgatgaaggctgctcgtgagttcttcgacctgcctctagaggaaaaaatggcatatttttctgaagattttgaggagagaattcgtttctgcaccagctttgttccttcaacggaagaacgctgggactggcaagacaacctctcgcatacttttccaccttacggagacgatcacccctggccaaagaagccacacttgtacgaggaagttgcgaaggagtatctccaccaggttttggagctggggaacgcaatcgcaggtgcaatctctgaaagcttgggcttagaaaaagactttctcctaaaggcgttcggagagggcaggcacaacatgcgtctaaactattatgcaccttgtccaagacccgatcttgcagtgggcttcagtcctcactccgacttcggaggttttaccatcctgatgcaagaccaagtaggagggcttcaggtgaaaaaggacgacgactggtactttgtcaaaccagtcaagcactccttcgtggtcaatatcagtgatcaa

SEQ ID NO: 5911 - DNA, 634 bp, Artificial
  Synthetic
ccaaaaaaaaaggaaaaaaaaaaaccaaaacacaccaagccaaataaaagcgacaatgggatcgctcaccaccaacatcgtcctcgccgtcgccgtggtggccgcgctggtcggcggcgggtcgtgcggcccgcccaaggtgccacccggcccgaacatcacgaccaactacaacgccccgtggctccccgccagggccacctggtacggccagtcctacggctccggccccgctgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgcc

SEQ ID NO: 5912 - DNA, 659 bp, Artificial
  Synthetic
ccccccccgggggcagtagcaagcaagcagggctaatatacataaattgatccagggatcgatcgaaattaatggcgggcaggagcaggaggaggtcgttttggtccgtgggcgttgcggctgctctgctttgtctgctggccgcccatggctgcagcgccaagcatcacaagcccaagcctactcccggtggcatcagtggcaatgcttcttcttcctcctccaattccagcacccccagtattcctcctcctgttgcccctactcctactgctcctactcctcctattcccagccccggaactggaagcagcaacggcagcagtggcggtggcggcggcgggtggctgaacgcccgtgcgacctggtacggcgctcccaacggcgctgggccggacgacaacggcggcgcgtgtgggttcaagaatgtgaacctgccgcccttctcggccatgacttcctgcggaaatgagcctctcttcaaggacggcaagggatgcggctcctgctaccagatccgatgcgtggggcacccagcctgctcggggctcccggagacggtgatcatcacggacatgaactactacccagtgtcgctgtaccacttcgacctcagcggcacggcgttcggcgccatggccaaggacaaccgcaacgac

SEQ ID NO: 5913 - DNA, 538 bp, Artificial
  Synthetic
cagctatggctttttccatctccaagaaggctgcagttgctgcactcttctccttccttgttgtcacctgcgtcgccggcgccaggccggggaacttcagcgcctccgacttcaccggcgatcccaactgggaagtcgccagggccacctggtacggcgctcccaccggcgccggccctgacgacgatggcggtgcttgcgggttcaagaacaccaaccagtacccgttctcgtcgatgacctcctgcggcaacgagcctatcttcaaggacgggaagggctgtggctcatgctaccagataagatgcgtcaaccaccctgcctgctccggcaacccggagacggtgatcatcaccgacatgaactactaccccgtttccaagtaccacttcgacctgagcggcacggcgttcggcgccatggccaagccggggcagaacgaccagctccggcacgccggcatcatcgacatccagttcaagagggtgccgtgcaacttccctgggctgaaggtggacgttccacgtggaggaggggt

SEQ ID NO: 5914 - DNA, 658 bp, Artificial
  Synthetic
caaaaaaaaaaggaaaaaaaaacaaaacacaccaagccaaataaaagcgacaatgggatcgctcaccaccaacatcgtcctcgccgtcgccgtggtggcagcgctggtcggcggcgggtcgtgcggcccgcccaaggtgccacccggcccgaacatcacgaccaactacaacgccccgtggctccccgccagggccacctggtacggccagccctacggctccggctccaccgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgccgacgacggtgacgtcatccagatggac

SEQ ID NO: 5915 - DNA, 703 bp, Artificial
  Synthetic
attcacaaataactaacacccatcagcaacaatggcatcctcttgtctccttctggcctgtgtcgtggcagcggccatggtgtctgcagtgtcatgtgggccgcccaaggtgccgcctggccccaacatcactgcggcctacggcaaacagtggctggaagctaggggtacctggtacggcaagccaaagggtgccggccccgacgacaacggcggcgcttgtgggtacaaggacattgacaaggctcccttcctcggcatgaactcatgtggcaatgaccctatcttcaaggatggcaagggctgcggctcctgctttgaggtcaagtgttccaagccagaggcctgctccgacaagcccgtcatcatccacatcaccgacatgaacactgagcctatcgccgcctaccacttcgacctctccggccatgcttttggtgccatggctaaggaaggcaaggatgaggaactccgcaaggcgggaattatcgatatgcagtttcgtcgcgtccgctgcaagtaccctggtgagactaaggtcaccttccacgttgagaagggctccaaccccaactactttgcagtgcttgtcaagtacgtcggtggtgacggtgatgtcgtgaaggtggaacttaaggagaaaggctctgaggagtggaagccactcaacgagtcatggggtgctatctggaggatagacact

SEQ ID NO: 5916 - DNA, 673 bp, Artificial
  Synthetic
cccacgcgtccgatctcacttcactctctttctcttctcttcacttcaccaccgccacctctctcatcggatccctgcagaggaggagagggcagtggcggcgaaaggcgacatgggctcgctgtcctctctcgccgccgcggcggtgtttctctccctcctcgccgtcggccactgcgccgccgccgacttcaacgccaccgacgccgacgccgacttcgccggcaacggcgtggacttcaactccagcgacgccgccgtctactggggcccctggaccaaggccagggccacctggtacggccagcccaacggcgccggccccgacgacaacggcggcgcgtgcgggttcaagcacaccaaccagtacccgttcatgtcgatgacctcctgcggcaaccagccattgttcaaggacggcaagggatgcggctcttgctacaagatcagatgcaccaaggaccagtcgtgctccggcaggtcggagacggtgatcatcaccgacatgaactactacccggtggctccgttccacttcgacctcagcggcacggcgttcggcaggctcgccaagcctggcctcaacgacaagctgcgccactccggcatcatcgacatcgagttcaccagggtgccatgcgagttcccggggctcaagatcgggttccacgtg

SEQ ID NO: 5917 - DNA, 638 bp, Artificial
  Synthetic
tccaccagcaataacattatattgcagcaatggcatcctcctcccttctactcgcctgtgttgtggtggcggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtgacgtcgtggaggtggaaatcaaggag

SEQ ID NO: 5918 - DNA, 619 bp, Artificial
  Synthetic
cagaatcctacctgactagtactaccactactagctagtagcgagctactctctctggtcatcaagctttgagtggttggagtggtggcagctatggctttttccatctccaagaaggctgcagttgctgcactcttctccttccttgttgtcacctgcgtcgccggcgccaggccggggaacttcagcgcctccgacttcaccgccgatcccaactgggaagtcgccagggccacctggtacggcgctcccaccggcgccggccctgacgacgatggcggtgcttgcgggttcaagaacaccaaccagtacccgttctcgtcgatgacctcctgcggcaacgagcctatcttcaaggacgggaagggctgtggctcatgctaccagataagatgcgtcaaccaccctgcctgctccggcaacccggagacggtgatcatcaccgacatgaactactaccccgtttccaagtaccacttcgacctgagcggcacggcgttcggcgccatggccaagccggggcagaacgaccagctccgccacgccggcatcatcgacatccagttcaagagggtgccgtgcaacttccctgggctgaaggtgacgttccacgtggagg

SEQ ID NO: 5919 - DNA, 659 bp, Artificial
  Synthetic
atttctttcttctatttactcttcaactcaatttttattaacattgaaaaagaaatctaattaagtaatggcagtgtcagcggtagcaactcttctatttcttcttgttgcttctccggttgcttttgccgccaaccatgtcgttggaggcagtggcgggtggagccagaccgtagattactccacttgggctgctggtgaaaccttcaacgttggtgacacccttgagttcaactatggtgcaagccacagcgtggatgtaataagcaaagatgactatgaaaattgcaacaccggaaacgccctcgagtctcacagcgacggcaaaaccaccatcaaactttccaaggccggtccaatgtacttcacttgttccacatttggtcactgtcaatctggcatgaaattaaccgtcgatgtcaaagatagctcctccactccgtcaactccgtcaactccttcaactccttcaaccactccttcaactccgtcaaccactccttcaactccttctgactcacccaccacacccacccctgaggttggcaactcgccgtcgaagtcgacacctgtagcacctaacggagcagccggagttatgggcaaaactgtagtcggattttcagttgtgttgggagctatgtttgcgttcatgtgct

SEQ ID NO: 5920 - DNA, 691 bp, Artificial
  Synthetic
ttctctctctctactagaatagcctctccaagaggacagaaggggattgaagaggaagaagaggaggagagagagaagaagaagaagaagatgggtctaaggcagggaagtggcagtgcattgtctctactagtggtggcttcggttgctcttcttctcatggtaggatctgctagagctactgagcacattgtgggaagctctgcgggatggcttgttccgtctgcgaacgtaaattacaccacctggtcttccacaaatatctttcatgtcggagataccctcttgtttaagtacagcaatatcagtcacaatgtggaagaagtgactgaagccaactacaacggatgcaacacggtaagccccatatctacttacacggatggaaacacgacaatcgaactcaccaagacaggcatgcattactttctatgtggtttcccgagccactgcctggggggtcaaaaggtctctgtaaatgtagttgcggagggcacaacatccaactcaacatccaactcaactgggtcctcaagtggggtttcgctattggattttaatctcatattcaagccctcatcacccctgctaggtattgggttcttcttcacccttctctctttgatcttttaaatgtaaatatagctcaatttgagccttttttctcaagagaatggttggaaatttaaga

SEQ ID NO: 5921 - DNA, 644 bp, Artificial
  Synthetic
ccctcgaccacgcgtccggtcaagttaggacaaaatcattttgtcaccaacatggagactctacgaaaatctttgttgatttttgctattgttgtgacagtaatataccagaaaaaagcaatggcggcacaacatgttgttgggggaagccaaggatgggatgaatctagagttaactactcctgggcgtctggcgagacattcaaagttggagatacactagtatttaggtacaatccaggtcttcacagcgttgtcgaagttgagggtgaaagtgcatacaagagttgtgatacaagcagttcagtgaactcaatgagtgcaggtaacgatgttgttaaactaaacaaaccagggactagatattttgcttgtggaacagcaggtcattgtgatcaaggaatgaagcttaagatcacaactgttactggaaatgcaccttctaatcaggctgctacttcttcgaatcctagttcttcttctgtggctgattcgcgtcgtttttctactgcgttcttcactttcgtagcagcgatatttactatacaaatggctctagtcttccagttataagataaacttgctttatttggttctatgatgaggagtagctggtatttatagggaatggagtactatgttaa

SEQ ID NO: 5922 - DNA, 592 bp, Artificial
  Synthetic
aaactaactctctatctctcttccttaaagaacacagttggtagaaacaagaaaacacaagcaacatgggaacttttaattctgggattattttcgttttcgttttgttcatatgttgtgttgtaccaagttttgccacagtttatactgttggagactcagctggctgggcaattggcgtggattatagcacttgggcaactggaaaaacgtttaatgttggtgattcacttgttttcaactatccaagtggtcacacagtggatgaagtaagtgctagtgactatcagtcatgcactgttggaaattccataacgtccgatcagagcggcgccactactattcctctcaagaccgccgggactcgttacttcacttgtggcgtaatgggccattgcagcggcggcatgaagcttgccgtcaccgttgcggcagccagtggcggtggaggaggttccaccacaccatcatccggcaccaccacaccatcatccggcaccactacttctacagctacccctacacctgaaactactaatactactactgggacaacttcacatccatcagcatcagttactttgtcaccatt

SEQ ID NO: 5923 - DNA, 620 bp, Artificial
  Synthetic
tttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttgtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgc

SEQ ID NO: 5924 - DNA, 695 bp, Artificial
  Synthetic
atcgatttctagcttagcttctactgccaattgcttggagatcgatcgaccatcatctccatcgatcctcaaagtcgatatatagctaattggaccatattccatggcgatcatggcagccagagctctcctcgtcgtcgccatggcggcggcggtgctcggaacggcgctcggcgccacctacaccgtcggagctccgagcggctcatgggacttgaggactaactatgaccagtgggtttccaacatcaactttcgtgccggagaccagatagtgttcaagtattctccagcggctcatgatgtggtggaggtgaacaaggccgactacgactcatgctccagctccagccctatcgccaccttcaactccggcgatgacaccatccctctcaccgctgccggcacccgctacttcatatgtggcttcaatggccattgcaccggagggatgaaggtcgctgtcaaggttgaggccgccaccggcagcaacccggccccatcaccgatgacccctcgaccacgcacaccgacagcaatggcaccgaacgcaatgccgccaacggctggtggccggcccgtgcctccatctaactcagcaagccagcccactggtgttgcatctctagttggtcttagtttgggtgccatagttgttggtctcatggccttctaaattagagtaagaagatact

SEQ ID NO: 5925 - DNA, 602 bp, Artificial
  Synthetic
cccacgcgtccgcctctcgccgtcgcagatccgatccaggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgcccttggcgccgaggtccgctggtgctcctgcaacatcttctccacgcaggaccacgccgccgccgccatcgccagggactccgccgccgtgttcgcctggaagggggagaccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccat

SEQ ID NO: 5926 - DNA, 345 bp, Artificial
  Synthetic
  misc_feature (166)..(166): The residue at this position can be any nucleotide.
cagcgaaaatgtctaaacctgcatacaaagttgctgacatctcttaggcagaattcggccgaaaggagatcgttatggcagagaacgaaatgcctggattgatttcaatccgcgcaaaatatggaccggaaaagccgttgaaaggagctcgaattgctgggtgtcnattaactcctattcaaaccgctgtcttgattgaaactttgactgagttgggtgcaacagttcaatggtcttcttgcaacatttactcgacacaagaccatgctgccgctgctattgctgtcactggcgtaccagtctatgcttggaagggcgaaactgacgaggagtatgaatggtgca

SEQ ID NO: 5927 - DNA, 993 bp, Artificial
  Synthetic
cggacgcgtgggcttctctaaaacccttatagaagaagagaaaaaagcctctcaaatctcatctcaaaccacctaatttctctcatactcgctcgacccatggctctattagtcgagaaaaccacctctggccgcgagtacaaggtcaaggacatgtctcaggccgatttcggccggctcgaaatcgagctggccgaagttgaaatgcctggtctcatggcttgtcgtactgaatttggcccatcacaaccatttaaaggtgctaaaattactggatctttacatatgaccattcaaactgcagttttgattgaaacccttactgctttgggtgctgaagttagatggtgttcttgtaacatcttctccactcaagatcacgccgctgctgccattgcacgtgacagcgctgccgtgttcgcgtggaagggtgaaactttgcaggagtactggtggtgcactgagagggcacttgattggggtccaggaggtggtcccgacttgattgtcgatgatggtggtgatgctacactcttgattcatgagggtgttaaggcagaagaagagtttgctaagaatgggacaatcccagatcctaactctaccgataatgctgagtttcagcttgtgcttactattattaaggaaagtttaaagactgatcctttaaagtatactaagatgaaggaaagactcgtcggtgtttctgaggaaactaccactggggttaagaggctttatcagatgcaagctaatggaactttgctcttccccgctattaacgttaacgactctgttaccaagagcaagttcgacaacttgtacggatgccgccactcactgcccgatggtctcatgagggctactgatgttatgattgccggaaaggttgcccttgttgcgggttacggagatgtcggaaagggatgtgctgctgccttgaacaagctggtgcccgtgtgattgtgaccgagattgacccgatctgtgctc

SEQ ID NO: 5928 - DNA, 563 bp, Artificial
  Synthetic
tgtaaacccctctctctttccactctctctctctgtcccatttccgtcgtctttgttgcagctcactgcaagtcttcttccttcagggtgaagaggaacttctagagctttgcaaccttagctcgacggaaatggcagccatggaactatcagtacagaagacctctagcggtcgggagtacaaggtcaaggacatgtcccaggctgactttggccgtcttgagcttgacttggccgaggtggagatgccgggtctcatgtcctgccgaaccgagttcgggccaagccaacccttcaagggggcccagatcacaggatccctccacatgaccatccaaactgcagtgctgattgagaccctgacggcattgggtgctgaagtccgctggtgctcatgcaacatcttctccacccaggaccatgcggcggctgcgattgctcgcgacagcgctgccgtttttgcgtggaagggcatgtccctccaggagtactggtggtgcaccgagcgggcccttgactggggtgttggaagcggccctgacctcattgtcgatgacggagga

SEQ ID NO: 5929 - DNA, 621 bp, Artificial
  Synthetic
tctctctgtatttgttcttcttaaaaatcccttttacagaaaacccaaaagtagtgcaaaaattgagaattaatggcaaatctaggaggaattcgtgaggcaggaggatctgagaacagccttgagatcaatgatcttgctcgctttgctgttgatgaacacaacaagaaacagaatgcacttctggagttcggaaaggttgttaatgtgaaggaacaagtggttgctggaaccatgtactacataacactggaggcaactgaaggtggtaagaagaaagcatacgaagccaaggtctgggtgaagccgtggcagaacttcaagcaattggaagacttcaagcttattggggatgccgctagtgcttaacaagtgctaaatgaatgcatcttatgcttgtgaaaataaaggtaacatagtttcgcttgcgagtatttgaatatcgtaaagtaagctttaaactatgtcgtagtgttaagttacaagtaactgtaactttacaatgttccatatttcatattatatggtcctccatatgatagttctatgatatatcttgtatatgtactgcttttctattgctaatatatatctgagaagcataagcaattgcctttttga

SEQ ID NO: 5930 - DNA, 683 bp, Artificial
  Synthetic
cacgcgtccgcccacgcgtccgcccacgcgtccggccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 5931 - DNA, 758 bp, Artificial
  Synthetic
cccacgcgtccggttgaaggagaaaagagaaacgagtgcagtctgagtctgtccacagatgagagtatctcgaaacgccacactgctatttgttttaattttgtcattaagttttctcttctctgcgtttgggttaagcgaaaccggaggaggattttgcggtgaagaggaagagaaaggaaataatctgattgagatggctactcttggtggggttcgtgattcgcatgcttcgtcccacaacagcgacgagatccataaccttgccaaatttgctgtcgatgagcacaacaagaaggagaatgcgatgattgaatttgccagagttgtgaaggcgcaagagcaagttgttgctggtacactgcaccatctgactcttgaggtcatagatgctggaaaaaagaaactctatgaggctaaggtctgggtcaaaccatggttgaatttcaaggaacttcaagagttcactcatgttgaagatgttcctaccttaacttcttcagatctaggtgttaagcaagaagaggaaggctctggattgaagtcagtgcctgtgcatgatccggtggttcaggaagctgcagagcatgcaattaagaccatccagcagagatccaactcgctacttctgtatgaactccaagagattgttcatgcaaatgctgaggtcattggggaggacaatatgaagcttcatatgctcatcaaaactagccggggagggaagcgagaaaagttcaaagttcaagtgcaccata

SEQ ID NO: 5932 - DNA, 1191 bp, Artificial
  Synthetic
gtgttcgacttcaagtaccccgcattttgtggtaatttctgctgtgcatagatggaaaatatcaatttgttccagatgcggcaaaatttatcacaaaattaggtagaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggccgaggaggcgcagagccacgcggcgtgaaggtgggcggcatccacgacgcgccggccgggcgcgagaacgacctcaccaccgtcgagctcgcccggttcgccgtcgccgagcacaacagcaaggccaacgcgatgttggagttggggagggtggtgaaggtgaggcagcaggtggtgggcgggttcatgcactacctcaccgtcgaggtgaaggaacccggcggcgccaataagctgtacgaggccaaggtgtgggagagggcgtgggagaacttcaagcagctccaggatttcaagcccctcgacgacgccaccgcccgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgccctgaatggaatcgttggacacagttgtggaatgccatgctccattgcggaagaggcttgtgatcaactgccaatcgtgagtaggttctgtggccaaaagcatgcggatctgtatgattcacttctgaaacgttctgaacaggagttacttcttgaatttctccagaagaagatgcaggagctgaa

SEQ ID NO: 5933 - DNA, 588 bp, Artificial
  Synthetic
ttcgcattattatgcatgtcgagcgacggagggccggtgcttggcggcctcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgccgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgcc

SEQ ID NO: 5934 - DNA, 346 bp, Artificial
  Synthetic
agagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttgaatttcacttgttcaagttaatgattacaaatgctctgagagtaattaattatat

SEQ ID NO: 5935 - DNA, 655 bp, Artificial
  Synthetic
cccctagaggttgcacactgcgcatcatcaccctcctcgtctctccatctcaggtgagacgttactatctttctatgttcttatgtcattagtggtgattgcaagacttaggtctgcatctcagtcattgagaggcattggacaaaatcatacaatcaaagcttgcttcttccagagaaaatttgcatatatttctgaagcgaaggccatggatgccccggaggagattagtaagataaagatgtttggtggatacattaaacgctacaaacatcagagctctacacttggctgtgctatgaatttcacgatatatttccctcctgctgcacaagagaagaaagttcctgttttatactggctgtcggggcttacatgcacggatgaaaactttgtgcaaaaaagtggagctcaaagagcagctgcagcttgtggcatagctttggtagctccagatacatcaccaagaggtcttaacgtggaaggagaatcagaaagttgggattttggtgttggggctggtttctatcttaacgctgcacaggagaaatggaagaactggcgaatgtatgactatgtgacggtagagataccgaggctccttagtgctaactttggtgagcttgatacagcatgcgcttctctctctggacac

SEQ ID NO: 5936 - DNA, 607 bp, Artificial
  Synthetic
gatccgagaacagcagattcagagatggaggaaaaaccctgtgagatcagcagcgtaaagatgtttggaggttacaataagagatataagcacttcagtccgactctgggttgctccatgaccttccacatttacttccctccatccccttctccatcccacaaatttcctgtactttattggctgtctggcctaacttgctccgatgagaactttattgtcaaatctggagctcagcgtgcagcttccagcgaaggtgttgcgctaattgccccagatacatccccaagaggccttggagtggaaggagaggcagacagctgggattttggtgtaggtgctgggttttatcttaatgctactcaagagaaatggaaaaactggcattcaatgggtgggcatggtgctttgacaatctacttgaaaaacctcgacaagtacaagtctgtatccgcctttgcacctattgttaatcccataaattgcccatggggtcagaaggctttctcaaactatttgggcgacgaaaaatctgattgggaggaatatgatgccacttgcctaatttctaagtacaacaatgttttggccaccatcctaattgatc

SEQ ID NO: 5937 - DNA, 462 bp, Artificial
  Synthetic
ctcgagcttgcggccgcatcactcccaagattcgcattacctttcttataatcgccgagattgttcgagcctgaataatcaaaatggttgtgcttgctgctgccattgtggtcaagtctgggaaagtgattgtttccagacactatgtggatatgtcccgtatcagaatcgaaggtctacttgcagcttttcctaagctggttggaatgggaaagcagcatacctatatcgagacggagaatgtgcgatatgtttatcagcctattgaagctctgttcctgcttcttgttacaactaagcagagtaacattctagaagacctggccacccttactttgctctccaaacttgtacctgagtattccatgtctttagatgaagaagggatttccagggcatcttttgagctcatatttgcatttgatgaagtcatatctcttgggcacaaggaaagtgtgacag

SEQ ID NO: 5938 - DNA, 665 bp, Artificial
  Synthetic
gagacactgaggctgctctccaaactgattcctgagtactgcacgtcgttggaagaggaggctgtttgcaagaatggcttcaagatcattttcgctttcgacgaagtgatatgccaggaacacaaggaggctgtcacggcgtctcaagtaaaagagtatattgaaatggacagtcaggaggagaggatgcataggatgatgatgcagaccaagatcaacgagacgaaggatttgatgaagaagaaagcgaacgagatcgataagagcaagctcgacaaaacaagaccggatagaagcgggatcatgtccgtgcctatcacttttgataacggttacgatgttccctcgactggaagaagcaacgggtttgcggccgagattgaaagcaagaccaaaggccgaccaacaacagcgggagctgcttctggcaagaagggaatgcagctgggcaagggacagaaaaatagccgaattatagagtccctgaaggcggaaggggaggatatcgtagaagacgttcaagctgcggccgtggtaggctctttagcgacaaatataccgacggatccgatcgctgttatagtcgaagagaaaatcactgtccaatgtaagagagacggtggcttggaatcgttcgatctgcaaggaacattgtctcttgtggt

SEQ ID NO: 5939 - DNA, 265 bp, Artificial
  Synthetic
tccaccggagcacacgaaaatggtagttctagcgtcgtccattatcaataagagtgggaaagcactcgtttcccggcagtttgtggagatgacgagaattcgaatcgagggacttctcgctgcgtttccaaagcttgttggtactggcaagcagcacacttttgtggagactgaccacgtccggtatgtgtatcaacctatggagtccttgtatttgatcctcgtcaccaacaagcaaagcaacattctacaagacttatagacc

SEQ ID NO: 5940 - DNA, 626 bp, Artificial
  Synthetic
acgcgtcggagagagaagagagagagagggcgagcctgtttaggtccaagaagttccatcggccttttcatactctgcgctttctctctcgtcaaaatggtggtcttggcggcgtccgtcatctccaaaaccggcaaagctcttgtttcgcgtcagtttgttgacatgacacggatacggatcgagggcttgctggcagcatttcccaatctggttggcagtggcaagcaacacacttatgttgagacggagaatgttcgctatgtttaccaaccgatggaatctctatacttgctactcgttaccaacaagcagagcaatattcttgaagatcttgacacacttcgcatgctctctaaaattgtgccggagtattgcccctctctggaagaggaagccatctgcaagatggcgtttgagattatatttgcctttgacgaggttatatccctagggcacaaggaaaacatcaccatcgcgcaggtgaagcagtacacggagatggagagccacgaagaacggctacacaatctgattgttcaaagcaagataaatgagaccaaggatgtgatgaagaagaaggcgagtgaaatccaaaagaacaagacggagaaaatgcggtcaga

SEQ ID NO: 5941 - DNA, 503 bp, Artificial
  Synthetic
tcttcgtcagcaagtgttcttcactctggtggtatacgatctattgcctaagatctgattcagcaaaatctactaagcagcgaagatggttgttcttgcggcttcgataatttctaaatctggcaaagcacttgtctcgaggcagtttgttgatatgtctcgtataagaattgaagggtatcttgcagctttccccaaattggttggtacaggaaagcagcatacatatattgagactgacaatgtgcgatatgtttatcaaccgatagagtctttgtacttgctacttgtgaccaacaaacagagcaacattcttgaagatcttgagacactgaggctgctgtctaaactagtgcctgaatattgtcattcactagatgaggaaggaattggcagtacatcgtttgagcttatttttgcatttgatgaagtgatctctcttggacacaaggaaaatgttacagttacacaagtcaagcagtattgtgaaatggagagccatg

SEQ ID NO: 5942 - DNA, 390 bp, Artificial; identical to SEQ ID NO: 4889
  Synthetic

SEQ ID NO: 5943 - DNA, 668 bp, Artificial
  Synthetic
cggacgcgtgggttttgtcaagcaatccttaattttcagcgaaaaaaatggcagatgaagttgtccttttggatacctatgtaagcgtgtttgggatgagggttaggtttgcgctggccgagaaaggcataaagtatgaatacaaggagcaggatttgctgaacaaaacccctcttctcctacaaatgaacccaattcacaagaaaattccagtcttgatccacaatggaaaaccaatatgtgaaacccttatcattgttcagtacatagatgaagtttggaaggacaaatcccctttaatgccctccgacccttatgagagagctcaagctaggttttgggctgattatattgacaaaaagatttatgatgctggaaggaaaatttggactacaaaaaaggaggatcaagaagcagcaaataaagaattcatagagtgctggaagttattggaaggggagttaggagacaagccatactttggaggggaaagttttgggtttgtggatatggcccttattccttactattgctggttccctacttatgagaaatttggcaattttagcatagaggcagagtgtcctaagattgtggcatgggctaagaggtgtatgcaaaaggagagtgtctcaaagtctcttgttgaccctggcaaagtctatgat

SEQ ID NO: 5944 - DNA, 391 bp, Artificial
  Synthetic
cccacgcgtccgagaagaagtcatggctcagaacgatacagtgaagctgataggttcttggtctagcccttattcccttagggcacgtgtggctctacacttgaaatctgtcaagtacgagtacttagacgaacctgatgttcttaaagaaaagagtgaactccttctcaaatctaaccccatccacaagaaagtccctgtcctcctccatggtgacctctccatctctgagtccctcaacgttgttcaatacgtcgacgaggcttggccctccgttccttcaatccttccttctgatgcctatgatcgcgcatctgctcggttttgggctcagtacatcgatgacaagtgttttgcggcggtggatgcggtggtcggagcaaaagacgac

SEQ ID NO: 5945 - DNA, 651 bp, Artificial
  Synthetic
aatcccatccacaagaagatcccggtcctcagcgcttgggcgagccccttcagcatgcgagtcaagttggcactcacactcaaaggcatcgagcacgaagatcttccacaggatctcagcaacaagagcaagctgctgctcgactccaatcccatccacaagaagatcccggtcctcatccacaaggggaggccactgcccgagtcagtcaccattgtccagtacattgatgaggtatggcctggaaagtccccgctgctgcctcaggatccattccttcgtgccgagcaccgcttctggaccgacttcatcgacaagaagttcttcgactgcttcatgcgcttcatgcgcactgaggataatgcggcaatcaacgaagaatttgtcgagaattggatgcatctcgagagagcgcttgagaagctcggaagcgagaaggggccgttctttggcggcgagagcatgtcgttcctggacgtgattcttgcccctttcagcgtttggatccctgccggtggcaatgtcctcggcttcaagacgccccatgagaaatgcccgcgtctacacaagtggtttgctgccatctctgagcatcccgatgccaaggccgctttgcctccagtcgggaagatggaggagttcatccgaggt

SEQ ID NO: 5946 - DNA, 740 bp, Artificial; identical to SEQ ID NO: 4897
  Synthetic

SEQ ID NO: 5947 - DNA, 540 bp, Artificial; identical to SEQ ID NO: 4884
  Synthetic

SEQ ID NO: 5948 - DNA, 614 bp, Artificial; identical to SEQ ID NO: 4909
  Synthetic

SEQ ID NO: 5949 - DNA, 901 bp, Artificial; identical to SEQ ID NO: 4910
  Synthetic

SEQ ID NO: 5950 - DNA, 731 bp, Artificial
  Synthetic
cttattcttcttctcacttgcttttcataacaatggcgaacgaagaggtgattctgttggatttctggcctagtatgtttgggatgaggctgaggattgcattagctgaaaaggagataaagtatgagtacaaagaagaggacttgaggaacaaaagccctttgcttttacaaatgaatcctatccacaagaaaatcccagtgttgattcacaatggaaaacccatttgtgagtctattattgcagttgagtacattgaagaagtttggaaagacaaagcccctaatttgcttccttctgatccttatgacagagctcaagctaggttctgggctgactacattgacaagaagttgtatgatgttgggaggaagttatgggcaacaaaaggagaagagcaggaggcagctaagaaagatttcatagaatgcctcaaggtgctggagggagcattaggagacaagccttactttggaggggaaagttttgggtttgtggatattgctctgattggatactacagctggttttatgcctatgagacttttggcaacttcagcacagaggccgagtgcccaaagtttgtggcttgggccaaaaggtgcatgcagagggagagtgttgctaagtctttacctgaccaatctaaagtccttgagtttgtaaaagttcttaggcagaagtttggacttgagtaaacatatgcatatttggttatgcaccataatgta

SEQ ID NO: 5951 - DNA, 597 bp, Artificial; identical to SEQ ID NO: 4911
  Synthetic

SEQ ID NO: 5952 - DNA, 530 bp, Artificial; identical to SEQ ID NO: 4912
  Synthetic

SEQ ID NO: 5953 - DNA, 615 bp, Artificial
  Synthetic
cccccgtgcccgtgctcatccacaacggcagggccatctgcgagtcgcagatcatcgtggagtacgtcgacgaggcgttccctgacgccggcgagtccctcctcccctccgacccttacgaccgcgccgtcgctcgcttctgggccgcctacatcaatgacaagttcatgccggcgtggcagaaggcgtcgttgggcctcacggaggaggagaaggcggaggcggtgaagcagatgctcgccgcgatcgagaacctggagacggcgttcaatgagttgtccaaggggaagcccttcttcggcggcgacaccgccgggtacctcgacgtcacgctcggcgccgtggtcggctgggcgcgcgccggcgaggtcctgttcgggaggaagctcttcgacgccactaggagccctctcctggcggcgtggatggagcggttcgtcgcgctggacgctgtcaaggcggtgttgccggacaatgccgagctgatcgagtatggcaagatgaggatggcgcactacgccaagcttgctgccgccttggctgctgcgaacaagaagtgagccggcgaagcaaacctgtagttggtgtgtgtccgttctcgttgctcgtggtctc

SEQ ID NO: 5954 - DNA, 502 bp, Artificial; identical to SEQ ID NO: 4919
  Synthetic

SEQ ID NO: 5955 - DNA, 566 bp, Artificial; identical to SEQ ID NO: 4916
  Synthetic

SEQ ID NO: 5956 - DNA, 577 bp, Artificial; identical to SEQ ID NO: 4907
  Synthetic

SEQ ID NO: 5957 - DNA, 611 bp, Artificial; identical to SEQ ID NO: 4905
  Synthetic

SEQ ID NO: 5958 - DNA, 591 bp, Artificial; identical to SEQ ID NO: 4902
  Synthetic
  misc_feature (406)..(406): The residue at this position can be any nucleotide.
  misc_feature (425)..(425): The residue at this position can be any nucleotide.

SEQ ID NO: 5959 - DNA, 746 bp, Artificial
  Synthetic
cccccccccccacaaatagacctctctgggcattcctctctgtcgactaatttgctccccattttcataccaagaaaccgtatcagcaatggccaagattgttgcagttttacttttggccctttttgccatgtccattcttgctacaacagttctggctacaaatggcaaacaccaccattctaaaaagtatggaccagggagcttgaacccctcacaatgcctaccacaatgtacgaggagatgtagcaaaacacagtaccacaaaccatgcatgttcttctgccaaaaatgctgcaacaaatgtttgtgcgttccacctggtttctatggtaacaaaagtgtttgcccctgttacaacaactggaagaccaaggaaggaggaccaaaatgcccttgatttttctactattttcttcatctgtctttaatttgtctacctaatcttgttattttgtctactcttgttcccgttgtattttttttctaacgacaagtcctttatgtccttccccaaacactatcctacccccaaaccctacttgtaggaattcactaggttttttgttgttgtaacaaaaagatcaacatgttcttagatcttaatttccagctgaaattgtagttgtgttgtagtgctcctatagtttggtgtggccctatatgagagctttctgttccaattatgttggtattactattgttgagttttcttttttctgcagtaataaaattatgttgatttt

SEQ ID NO: 5960 - DNA, 785 bp, Artificial
  Synthetic
aattattctctttagacaaattatagcaatggctgcgaaactgagcattgtcttgtttgttattttggtagtttttttggcccaaaatcaggtttcaagggccaacctagtgcttgatgggaagcaacaaatgcagagaaataaccaaatgtatggtgttagtcagggaagcctccatcctcaagattgtctcccgaaatgcacatatcgctgctcacagacttcattcaagaaaccctgcatgtttttctgccagaaatgttgctcgaagtgtctgtgtgtgccccctggcacctatggcaacaaacaaacctgcccttgctacaataactggaaaaccaaggaaggtggccccaagtgtccctgattgtacccttccttccactattatctatatatccatctatatattgtgtgacagacacccaacttctgtcagttttcatctatctgtcaagtctattagtaactagcacttggttcaagtggtctgtgttagctagcaaatgatcaatttaagctccaatataaccactttttggcaaagccaggaagatgagttataatgcaatgacagtaactatgcgctagcaattgctcctagaaatctgtattctcgtcatactccatgcttgtatgcagcctattgacgagctatgtttatgagtagtagtagttcttatgctatttaatgcaatttcttaagaacttgtattttaagatatgtaatccatattctatttggtgttccttaccaatatgtgaatgatgccctatattaaagc

SEQ ID NO: 5961 - DNA, 625 bp, Artificial
  Synthetic
ggttcttctacataaaacactaacaggcttatttgttctcaagaaaatcagcaatggccaaactcgtttcatttttccttttggcccttgttgccatatccatggttgcaaccactgttttggctgcagatgcccagtaccaccttgatacttcaaggtacggtccagggagcttgaagccatcacaatgcctgccacaatgcacgaggagatgtagcaagacacagtaccacaaaccatgcatgttcttctgccaaaaatgctgcaaaacatgtctgtgtgtcccccctggtttctatggaaacaaaggtgtttgcccttgctacaacaactggaagacccagcaaggaggacccaagtgcccttaattttactttatggaattcgttccccaatttaatttatgttgttgtttgtcggtattgttattaaatttgtcttgaatcaaaggtcataagttgtacgaccttgattctaattaagttacttttactgtattgctcctttgggccgaatactttttgtgttgcccgatgtgagagctctttgaccaattctttttggtctattgtacgttttaattactcttatctaatataacaaaatgttcttcaaattgtgattc

SEQ ID NO: 5962 - DNA, 668 bp, Artificial
  Synthetic
ataaccactactaccttccttcagcagagaagggaagagaagagaagtgggtgcttttctctttcatccctttctctctctctctctctctctctctctcatctatggctaccctccatgttcttctccttgtcttgcttgcccttgtcctagctgccattatgggaactgagagtgtggaggtcagtagtggtgtggattctactgcaattggagatatgaaggccaagtcatggagctcttacaaagtgcccctctcaggctgcccgggtgcttgcaacaagagatgctctgccacatcgaagaagaaggcatgcatgttcttctgtagcaagtgttgttccaagtgtttatgcgtgccccctggcacctatgggaacaagcaagtgtgcccatgctacaacaactggaagacccaacaaggaggacccaagtgcccttgagcacaaaaccaccactactcacacatcctagccaattaccatgaacccctccccactcttcccatttgagtggagtattggcacaagtgatgatgtggctagcagaggcttaatatttgcaaccaccacataggtggaacctttaatttcataccactaatgatccgatgatccgatcccttttatatctatagctaatccctactatacctatatctaatccct

SEQ ID NO: 5963 - DNA, 494 bp, Artificial
  Synthetic
attttggcagggttacaacaatctccgtcctaaagattgcgggccaagatgtacatatcgatgctcagcaacatcacacaaaaagccatgtatgttcttttgtcaaaagtgctgtgctacttgcttgtgtgtgcctcgtggggtttatggccacaaacaaacgtgcccttgctacaacaattggaagactcaagataacaaaccaaaatgcccttaaatattaattagggcgaaattcttttaatataattaattgtcaaaaaaaacaatattgtcgttttttcttgtatcggcgtaacttaatttcttttgcagttttaagtatgtttacacgttgtacttctctactttgttgttactgatgtctatgatgagttatagttctggagcaatatggtccgtgaggatttataagccgtaacttgcttggaattgagttgttgttgtagtgtgtttttatcatcgcgagaatataatataataaattatttatt

SEQ ID NO: 5964 - DNA, 483 bp, Artificial
  Synthetic
cgcgggagatttagaggagtgtttggttctttggataacaatatcccaaactgaaaatggctaagtcatatggagctatcttcctcttgaccctcattgtcctcttcatgcttcaaaccatggttatggcctcaagtggatctaatgtgaagtggagccagaaacgttatggaccaggaagcctgaaacgtacccaatgcccatcggaatgtgataggaggtgtaaaaagacacagtaccacaaggcttgcattacgttctgcaacaaatgctgcaggaagtgtctctgtgtgcctccgggttactatgggaacaaacaagtttgctcctgctacaacaactggaaaactcaagagggtggaccaaaatgcccttgaaaaaatctcccttcgttccctttttataataaaaattttcaactataactaaatttcctttgatcaatgttttatctactttattcctaatgttgtaatgttatgt

SEQ ID NO: 5965 - DNA, 674 bp, Artificial
  Synthetic
gggcatcatggcgcggtgcggatggctgctcctcctcgcgctcctcgccctcgtcctctcaggtggatcccgaggtgagctggacgaggagatagatccgtcgtcgtctgctgcgggcgacgaggcgggagcggtggacgtggacgaggctgtagttgacgcatttgattccgtcggtcccgcgcctggagtcgacactgtctaccacttcctaaacaatccgcagaaactcgttcctgccggagagcccgcgcagattctcgtcgggatcgccaacaccggcgcctctgttgtcaacgttaactccatccgggcgtccattcaccttccgtttgatcacaagctcttggttcagaacttgacagcccaggagtttgtgaatgcgaccgttccgtcgggtgtccaggcaacttttgcgtatcccttcaccgtgagcaagtatctgcaaccagggagtttctcgctggttgcaagtgtgctctatgaagtggacggagatatccacaagactgtcttctataatggcacggtcgagattgtggaggccggtggattcttgagcggggagacgcttttcctggtcactctcgggcttggtctgatggggctcttggccttgtggatccatggacaagtccagcgtttctcaaagacacggaagacgcgggtggtcg

SEQ ID NO: 5966 - DNA, 430 bp, Artificial
  Synthetic
tggtatcaacgcagagtggccatctaggccggggcagctggtgaggagagtgagctgttagttggaatgaaaaatgatggggaatcaaatctgaatatcattgccatccaagccagtgttcaccttccttttgatcatcgctatttggttcaaaatctttctgttcaggcttttaacaatgcaaccgttcctccttcagctcaggctacctttccatatatatttgctgtcagcaaatttatgcagcctggaagttttgatctcgtgggcacaattatttacgagatagaccagaatgcttatcaaaacatattctacaatggaactattgaagtgactgaacctggtggtcttctcagtgttgagtctgttttcctgttttgtcttggagttgccctccttggccttctcgggttctggatacgtggtc

SEQ ID NO: 5967 - DNA, 648 bp, Artificial
  Synthetic
gttcgtgtgctccgccttcctctcaaaatgaaaattagggttttcttcgtcctggctcttctcctcttctcttcatcatttctccaagttgctagagctcaatccgaccctgaagcagaagtggttgagagtaccgaggaaggaggggatcttggaattgttggtgaggatgtccaagattttagcagtgagagttatagtcctgcacctgggattgaaacaatttgtgttttccctaaaaacccttctaaagtagtggcagctggtgaggagagtgagctttggttggaatgaaaaatgatggggaatcaaatctgaatatcattgccatccaagccagtgttcacctaccctttgatcatcgctatttggttcaaaatctttctgttcaggcttttaacaacgcaacagttcctccttctgctcaggctacctttccatatatatttgctgtcagcaaatttatgcagcctggaagttttgatctcgtgggcacaattatttacgagatagaccagaacgcttatcaaaatgtgttctacaatggaactattgaagtgactgaacctggtggtcttctcagtgttgagtctgttttcctgttttgtcttggagttgccctccttggtcttctcgggttctggatac

SEQ ID NO: 5968 - DNA, 743 bp, Artificial
  Synthetic
gattcacctcatgttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgtcttctcttgctggaatgtcccgttgggcctctctctggagcctctcgttggagcattggcggccggcaatgcggtcgcgctgaagccatcggagctggcgccggccaccgctaagttcctcggcgacaacgtcggcaaatacatggacgccacggccgtgaaggtcatccagggcgggccggaggttggcgagcagctcatggaacacagatgggacaaggtccttttcaccgggagcccgcgcatcgcgcgcgtcgtgatggcc

SEQ ID NO: 5969 - DNA, 70 bp, Artificial
  Synthetic
gcaagttcacaacccaacacccaaaagcaaaagaaaagcagcaacccaaagatgtgcggcggagcgatcc

SEQ ID NO: 5970 - DNA, 1039 bp, Artificial
  Synthetic
cccccccggagcgagagagagagaaagggtctcctcctcaacatcaacaatggcggtcgcaacctccttcgccacactcgccatcgcgcggccggcggcggagcgggccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggagaaaaagggtttggttacaaggggtccagtttccaccgtgtcattaaggacttcatgattcagggaggagactttgacaagggcaacggtactggagggaaaagcatatatggccggaccttcaaagacgagaacttcaaattggttcatactggacctggagtggtcagcatggccaatgctgggccaaacaccaatggcagccagttcttcatctgcactgtcaagacaccttggttggatgggaggcacgtcgtgtttgggcaggttattgaaggcatggacatcgttaagatgatcgaatcgcaggagactgacagaggggaccgcccgaagaagaaggtggtcatcagtgagtgtggggagcttccagtggtctaataggtgccagagggctaatcttcttcccccggagactttgctgtttttggtttcatagtaagctgtgaacttatcgcatgttctccgcgcagtcagagatcatgctgagttgaggccaagatttctaagttgagaataatcctctattgttcggctggaataaaacgttcttacctgtcgagggtcaggaaataatgttgtggttcatgaaagatcaaatgtctgtcttttcgtgct

SEQ ID NO: 5971 - DNA, 972 bp, Artificial
  Synthetic
ctcactttccaccaaccactcccctttctctctatctctataattacagttaattcttcgtagagtcactccgacaagtatagaaattaccggataaaagaaatcggcaacaatggcagctacatttgctacagtgtcgaatttaggctcactctcagctcctcgagctgctgtgaaccctacatatgcttctcctaagttggtgaaatcttcattctcatcgtcaagtttcttttctggctcgttgcgcatttctaattcatccaaccgtttggttcacaaaaaaaccagcgctttatccggttccattcaagccgcagtgcaggtggccgaggtgcaatccaaagtgacacacaaagtttattttgatattagcattgggaatcctgttggaaagcttgctgggcgaattgtaattggattatatggtgatgatgtgccacaaacagcagaaaatttccgtgcactctgcacaggtgagaagggctttggctacaaggattctgcatttcatcgtgttattaaagatttcatgattcaaggaggtgatttcgataaaggaaatggaaccggtggtaaaagcatatatggtcgtacctttaaggatgaaaacttcaagttgactcatactggacctggagttgttagcatggccaatgcaggccctaataccaatggaagccaattcttcatttgcactgtcaagaccccatggcttgatgagaggcatgttgtgttcggacaagttttagaaggcatggacattgtgaaattgattgagtcgcaggagaccgataggggtgaccgtccaaggaagagggttgtcatcagtgactgcggtgagctacctgtggcatgaggcgggaatacaaatataaagcactttattatgttaagactcgttgccagatataagaggattctcagtactgagttttcatccaaaacccagctttttcctgttcctttttt

SEQ ID NO: 5972 - DNA, 477 bp, Artificial
  Synthetic
gagagagaaagagaaacagaaagagagagagagagagggaggagaagtcttcctagccatggccgcctcgcagtttctaaccctgggtagagttggacatcccataactactgggaatcatgttcaatgtagtccaatcatgtcacgaatgccaatgcggtctgcttctatcaaaaataccccctgtggattaaagatgaggtctgtcaagcttgcttattgtaatgtggcaagaaaacagctctccgtgacgtgcacagctcaagaagttggggcagtagcaaaggttacaactaagtgcttctttgacattacaattggaggagatcctgctggaagaattgtgattgggctatatggtgacgatgtgccagaaacagtggagaacttccgagcgctctgcactggagagaaagggtttggatataaaggctctggatttcatcgcgtcattaaagatttcatgatccaaggagg

SEQ ID NO: 5973 - DNA, 627 bp, Artificial
  Synthetic
gattctacaccggaaccacagccaaagatggcgacgacgagattacacccgtccgttttgatcctctgcatggtggtgatcggaaccgtagctcttgctcaggccaaatctcaggaaagtctgaaagaagtaactaacaaagtttactttgacgttgacatagatggtaaacctgccggtcgtattgttatgggtctcttcggtaaaacagttcctaaaacagcagagaacttcagagcattgtgcacaggggagaaaggtgttggaaagagtagcaagcctcttcattacaaggggagcacattccatagaataatccccagtttcatgcttcaaggtggtgatttcactcttggtgacgggcgtggaggtgaatctatttatggtgaaaaatttgctgatgaaaatttcaagatcaagcacactggaccagggcttttgtcaatggcaaatgctggtcccgacaccaatggttcacaattcttcatcacaaccgtcacaactagctggttggatggccggcatgttgtctttgggaaggtgttgtctggaatggatgtcgtttacaagattgaagctgaaggaagacaaagtggaacaccaaaaagcaaagttgtcattgcagac

SEQ ID NO: 5974 - DNA, 712 bp, Artificial
  Synthetic
gaattcaaacctcgctctacagtcccccagtttcgcaacaatggcgacttcacttgctcctctgatgaaaattagctttgcaaatgttaccaacaagcccaagtttataaaccctagttcttgtaattctctcggattaagaaaattatcttcttcttctagtttctctggttccttattgcgccttacatcttcatcttcatttccttccattcagagaagatatggttttgtgacacatgcttcttctcaggaagtggcattgcaatcaaaagttacacacaaagtatattttgatattggaattggtaatcctgttggtaaggatgtcggcagggttgtcattggtttgtttggtgatgatgtcccgcaaactgtggagaactttcgggcgctttgcacaggagagaagggttttgggtacaagggttcagcattccaccgtgttattaaagatttcatgattcaagggggagattttgataagggaaatggaactggaggtaaaagcatctatggtcgtacatttaaggatgagaacttcaaattggctcatgttggaccaggagttgttagtatggcaaatgcaggacccaacaccaacggaagccagtttttcatttgcactgtcaagactccatggttggatcagaggcatgtggtgtttgggcaagtgttggaggggatggacattgtaaagatgattgaggcc

SEQ ID NO: 5975 - DNA, 553 bp, Artificial
  Synthetic
agaaaggtttgaggaaaaagaagagggagggaagaaaggggaggttcttcttgctattgtaatggcgactatccccgtgaacccgaagcccttcctgaataaccttaccggcaagcctgttatcgttaagcttaaatggggcatggagtacaaaggttatcttgtctcaatcgactcatacatgaacttacagcttgcgagcactgaggaatatatcgatggaaaactgacaggcaaccttggagaagtgctaatcaggtgcaacaatgtgctctatttacgaggtgttcctgaagatgaagatatcgatgaagcggaataacaagatgtaattcttggtatgaaacatgaaggatcagcagctgagttgggaatgatctggagtgttccggaactttgtgtacgatgcaaaacaatttgggatgcggttgtgaaaacccctattttaggagttggacttagaaaaagacccattaacatacacataagagtagtgctaccacatgtaaaagacactttttgaaatttaagtcttttttattgggcaaaacac

SEQ ID NO: 5976 - DNA, 499 bp, Artificial
  Synthetic
cttccccttctcccacttttccttaaacccttgaaaagcttccatggcgacggtaccagttaatcccaagccttttttgaacaatttgactggaaagcctgtgattgtaaagctaaagtggggaatggagtacaaagggtatttggtctccgtggattcatacatgaacttgcagcttgcaaacgcagaagaatacattgatggacaatgcactggttctcttggagagatcctgattagatgtaataatgtcctctatcttcgtggtgtacctgaggatgaagaactggacgatgccgaccgcgactaggaagtgttttgtattagtgtgatcgttcttttagtgcaatcagatgtctggttcatcgatcatgatggaacaacatattcgtctccttgaatgtattatcaattatgtgtaaaatttcctagatgattactggagcaaaaagaaccagctctatgactagaactagaatgccatatggtcaagtttatt

SEQ ID NO: 5977 - DNA, 668 bp, Artificial
  Synthetic
gaattcagaagaagaagaagaagaaagaagagctctgtctttctctccatccccccctgtatacacctctttccctgcaaagatggggctgtcattcaccaagttatttagtaggctgtttgccaagaaggagatgagaattcttatggtaggtctagatgcggctggtaagactacaatattgtataagctcaagttggatttaatgtggagactgtagagtacaagaacatcagtttcactgtgtgggatgttggaggtcaagacaagatccgacccttgtggagacattacttccaaaacacccaaggtcttatcttcgtggttgacagcaacgatcgtgatcgtgttgttgaagctagagatgaactgcataggatgttgaatgaggatgagttgagagatgctgtgcttctagtgtttgctaacaaacaggatcttccaaatgcaatgaatgccgctgagatcactgataagcttggtcttcactctcttcgtcaacgacactggtacatccagagtacatgtgcaacttcaggagaagggttgtatgaaggtcttgactggctctccaacaacattgctaacaaggcatagaagtctcaacattgatattttggcctatgttggttgaatgttgaattatttagtattttcgtcatcataat

SEQ ID NO: 5978 - DNA, 1115 bp, Artificial
  Synthetic
gaattcccgagagagagattaatggaagttctgagatcgacaaagggaagacgtagaagattaaacaatagctgttggtgatggtgttatagccggttaatgtttcagatcggaaagattaattgaattagggtttcgtaaagaattgttctgagaagatgttgatgattaaattgaaggtttgggagaaagattgaaggtgggttttgagtatctaaagcaaaagagaagagttagtgtctgaattagggattctggaattaaattaaggctcataagaagaactctaagatgtttcagaaaatgaatctgatgttctagatagatgattagaaaggggttcagttgattgaggattgggttttgatgattgacggacgagatgagaattcttatggtaggtctagatgcggctggtaagactacaatattgtataagctcaagttgggagagattgttaccaccattcctaccattggatttaatgtggagactgtagagtacaagaacatcagtttcactgtgtgggatgttggaggtcaagacaagatccgacccttgtggagacattacttccaaaacacccaaggtcttatcttcgtggttgacagcaacgatcgtgatcgtgttgttgaagctagagatgaactgcataggatgttgaatgaggatgagttgagagatgctgtgcttctagtgtttgctaacaaacaggatcttccaaatgcaatgaatgctgctgagatcactgataagcttggtcttcactctcttcgtcaacgacactggtacatccagagtacatgtgcaacttcaggagaagggttgtatgaaggtcttgactggctctccaacaacattgctaacaaggcatagaagtctcaacattgatattttggcctatgttggttgaatgttgaattatttagtattttcgtcatcataaatgtcgttactgtatgtgtcttcttgttcgtatatttctctccccctgttaattgttgagaaaggaattgttcttaatacctttcttatgtgaatgatttctatgttacagactacatttgtttctctttagatccataataattgcagagcatattaaaaaaaaaaa

SEQ ID NO: 5979 - DNA, 772 bp, Artificial
  Synthetic
acgcgtcggttcttggctgtctagggcgatcgatctctccatcgccgctgcggatcgaagctcgccgccatggggctcaccttcaccaagctcttccagcgcctcttcgccaagaaggagatgcgaatcctcatggtgggtctggatgccgcgggtaagaccaccatcctctacaagctcaagctgggcgagatcgtgacgaccattcccaccatcgggtttaatgtggagactgtcgagtataagaacatcagcttcaccgtgtgggatgtcggaggtcaagacaagatccggccattgtggagacactatttccagaacactcaaggtctgattttcgtggtggacagcaacgatagagaccgtgttgtggaggccagggatgagctccacaggatgctcaacgaggacgagctgagagatgcggtgttgttggtgttcgccaacaagcaagatcttcccaacgccatgaacgcggccgagatcaccgacaagctcggcttgcattctctccgccagcgccactggtacatccagagcacttgcgccacctctggagagggtctctacgaaggactcgactggctgtcgaacaacatcgcgaacaagggctgagtgatcagtaccgatcgatccatttgaagttttgcgctttcatcatcatgactatctacaatatatagattacaaaaatgtggcttttgttctcttagctctagatataaatttgtgccccaattactctctggaaaaaagaaatgctgcgtctaat

SEQ ID NO: 5980 - DNA, 525 bp, Artificial
  Synthetic
gatgcggatcctgatggtggggctccacgccgccggaaagaccaccatcctctacaagctcaagctcggcgagatcgtcaccaccatccccaccattgggttcaatgttgaaactgttgagtacaagaacattagcttcactgtctgggatgtggggggtcaagacaagatcagacctctttggaggcattacttccagaacacacagggtcttatctttgttgtggatagcaatgatcgcgaccgtgttgtggaagctagagatgagctgcacaggatgctgaatgaggatgagttgcgtgatgctgtgttgcttgtgtttgccaacaagcaagatcttccaaacgctatgaatgctgctgagattactgataagcttggattacattcccttcgtcagcgtcactggtacatccagagcacttgtgccacaactggcgagggtttgtatgagggcctggattggctgtccagcaacattgctagcaaggcttgatgcttgatacgtggacctttaagacatgg

SEQ ID NO: 5981 - DNA, 599 bp, Artificial
  Synthetic
aagaggatggggctgctgacgatcatccgcaaggtaaagcggaaggagaaggagatgcgcattctcatggtgtaagatctctgctttgatctgtcgctcgacctctctttcttctcgctgtgcggcagaggattggacaatgcgggcaagacgaccattgtcaagcgaatgaatggcgaggacatcagcgatatcagccctactcttggatttaacatcaagacgatgcgttatggcaaactgaacatatgggacgttggtggccaaaagactttaagatcgtactggaggaactactatgagcaaacagatggtttagtgtgggtggtggatagcgctgatttgcgtcgcctcgacgactgcaagaaggaactacacaatcttctcaaagaggagcgtcttgccggagcttccctactgatactggcaaacaagcaggacatagatggtgctctaagcgtcgacgaaatctcaaaggtgctgcggctcgatctgatggacaaaagcaggcattcccgaacagtcggatgcagtgcagttactagcgatggattactcgaagcattcgactggctggtctcggacataggctcgcgtat

SEQ ID NO: 5982 - DNA, 356 bp, Artificial
  Synthetic
cccacgcgtccgattgctctttcaaatttcttcgagtctctctcgctctctccgtttcttcgcggtctctctctctcagatctctccgaaacattcttcgtagtgaagcaaaatggggttgagtttcgccaagctgtttagcaggctttttgccaagaaggagatgagaattctgatggttggtcttgatgctgctggtaagaccacaatcttgtacaagctcaagctcggagagattgtcaccaccatccctactattggtttcaatgtggaaactgtggaatacaagaacattagtttcaccgtgtgggatgtcgggggtcaggacaagatccgtcccttgtggagacactact

SEQ ID NO: 5983 - DNA, 341 bp, Artificial
  Synthetic
gattggaagcttctctctctctcggttttgatccctttcaattctccaaaggatcaacagttaaaaggaaaatggggctttcatttgcaaagctttttagccggctttttgccaagaaggagatgcgaatccttatggttggtcttgatgctgctgtaagaccaccattttgtacaagctcaagcttggtgagattgtcaccaccattcccaccatcgggtttaatgtggagacggttgagtacaagaacatcagcttcacggtttgggatgtcgggggtcaggacaagatccgtcccttgtggagacactacttccaaaacactcaaggtctgatatttg

SEQ ID NO: 5984 - DNA, 923 bp, Artificial
  Synthetic
gcgagaacagaacatccatagctttcgcattttattgtcatttctaaagggcagagtcttttctagatctgcccctctctctcgctctctcctgattcgttgttcatcactgcattgagaaaagatgggtttatcattcgggaagctttttagtcggctgtttgccaagaaggagatgcgtattctgatggtcggtcttgatgcagctggtaaaaccaccatattgtacaagctcaagctgggagagattgttaccaccattcctaccattggattcaatgtggagactgttgaatacaagaacataagcttcactgtctgggatgttggtggtcaggacaagatccgaccattgtggaggcattacttccaaaacacacaaggacttatctttgtggtcgatagtaatgatcgtgatcgtgttgttgaggctagagatgagctgcaccggatgttgaatgaggatgaactgagggatgctgtgctgcttgtgtttgctaacaagcaagatcttccaaatgctatgaatgctgctgagattactgacaagcttggtcttcattctctccgtcaacgtcactggtacattcagagcacttgcgctacctctggagaagggttgtatgaggggcttgactggctctcaaacaacattgcaaacaagggttgaatgcgagatccatgatttttgcagctatgtttttgtcaatatagacttcaacaatgtctagagcacttatgtacttactgatctttctttcgcgggatagatctgcttatccctattgttatcagtacgtttgccctttcttttaaagaatggtactctgcagcaactttaggttaaaattcatgtaatattttacactttggctgacatatgctcaaggactttgccttcaacattttattttaattgagat

SEQ ID NO: 5985 - DNA, 623 bp, Artificial
  Synthetic
gtagttctccttgccatggggctcaccttcacgaagctcttccagcgccttttcgcgaagaaggagatgcggatcctcatggtcggcctcgatgccgccgggaagaccaccattctctacaagctcaagctcggagaaatcgtcaccaccatacccaccattggtttcaatgtggagactgtggagtacaaaaacatcagctttactgtgtgggatgttggtggccaggacaagattagacctttgtggaggcactatttccagaacacacaggggttgatatttgtggtggacagcaatgacagagatcgtgcagtggaggcgcgtgacgagctgcataggatgctcaacgaggatgaacttcgagatgcagttcttcttgttttcgcaaacaagcaagatcttccgaacgctatgagtgcggctgagatcacagacaagctcggattgcattcgactcgccagcgtcattggtatatacagagcacctgtgcgacatccggagaagggttatatgaaggattagattggctctcaagcaacattgcaagcaaggtataaacaaacaagtgagtcatctgcaagtgaagctgattacgtgtacactttctctctggtggatg

SEQ ID NO: 5986 - DNA, 905 bp, Artificial
  Synthetic
ctttccgatcactacatattttccagcgttaatctcaggtttgtcctctcattagatccctcctccaaaagctcttttcagggatcatcaacaaggaagctaaatggggctgacattcaccaagctcttcagtcggctttttgccaagaaggaaatgcgcattctaatggttggtcttgatgcagctggtaagactaccatattgtacaagttgaagttgggagagatcgtcactaccattcccaccattggtttcaatgtggagactgttgagtacaagaacatcagcttcactgtttgggatgtcgggggtcaggacaagatccgtccattgtggaggcactacttccagaacactcagggtctcatctttgtggttgatagtaatgatagagaccgtgtcgtagaagcaagagatgaattgcataggatgttgaatgaggatgaacttcgggatgctgtgctgctagtttttgctaacaaacaagatcttcctaatgcaatgaatgctgctgaaataactgataagcttggactgcactcccttaggcagcgtcactggtacatccagagcacttgtgcaacatctggagaggggctttatgagggacttgattggctttctaacaacatcgctaacaaggcctaaatgatgcagatttgttattgcgggttgatcctggatgcaggcgggtttttatctagttattttttttcttctcaagtcagtgtggttatgaacatctccttaaaatcattttgcatcttcatagggctttttgtaatggctgtaagacgatggtcgaatatatgtaattgctgtctgttttaggtatattttcataaatttgtataacaaagactagctttcttataacatagcatttgttaatgattaaagcctt

SEQ ID NO: 5987 - DNA, 643 bp, Artificial
  Synthetic
cccatccatccatcatccatctcatcatcagcaaccaattcgcaccgatcgatcgatcgatcgatccagcaactagatcaacagtactagctaggaagcatggcccgtgcacagttggtgttggtcgccctggtggcagctctgctcctcgccgccccgcacgccgccgtggccatcacctgcggccaggtcaactccgccgtcgggccctgcctgacctacgcccgcggcggcgccgggccgtcggcggcctgctgcagcggcgtgaggagcctcaaggcggcagcaagcacgaccgcagaccggcgcaccgcctgcaactgcctcaagaacgcggcccgcggcatcaaggggctcaacgccggcaacgccgccagcatcccctccaagtgcggcgtcagcgtcccctacaccatcagcgcttccatcgactgctccagggtgagctgagccatcgatcagagagacggatcatatatatacagcagcgcgccggttgccacctagtagattctgcctgggtcgatgtgtggagccgaattctgtatccagtactagtagtatcatatctgtattctggaataaaagatgagctagctaaggtctcgatcaatcaccatgcatgcatgtgtgtgcatccatg

SEQ ID NO: 5988 - DNA, 667 bp, Artificial
  Synthetic
cccacgcgtccgcccacgggtccgctcacctgcagcagcaaacgagcaccacacaccagcagcagcagcaagtcgatcgatcgtcagcacacacgaccaagatcgagatggcccgtgcacagctggtgttggtcgccctcgtggcagcggctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccagcaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccagcgtgaactaatccgatcgatcgctaccggaggatgacatgcagcgccggccgagatgcagctgtcgtctcacgctttgtatcttgtgttatctgtgtttatgctgaataaaatgagagctagctagctaggtcgatccatcgccatgcatacatggttgatcgcccggccggtcactacgctatctgtttccttaatttattcgtcgatcgac

SEQ ID NO: 5989 - DNA, 811 bp, Artificial
  Synthetic
ccccatccatccatcatccatctcatcatcagcaaccaattcgcaccgatcgatcgatcgatccagcaactagatcaacagtactagctaggaagcatggcccgtgcacagttggtgttggtcgccctggtggcagctctgctcctcgccgccccgcacgccgccgtggccatcacctgcggccaggtcaactccgccgtcgggccctgcctgacctacgcccgcggcggcgccgggccgtcggcggcctgctgcagcggcgtgaggagcctcaaggcggcagcaagcacgaccgcagaccggcgcaccgcctgcaactgcctcaagaacgcggcccgcggcatcaaggggctcaacgccggcaacgccgccagcatcccctccaagtgcggcgtcagcgtcccctacaccatcagcgcttccatcgactgctccagggtgagctgagccatcgatcagagacggatcatatatatacagcagcgcgccggttgccacctagtagattctgcctgggtcgatgtgtggagccgaattctgtatccagtactagtagtatcatatctgtattctggaataaaagatgagctagctaaggtctcgatcaatcaccatgcatccatggttgatcggcccggtcacgctagctagctttcttcttcttgtgtgttcgtctcgtacgttttgctccttttcgaggggtacgtgtaccagagagagctagagattctacatgcatgtactgcaactccttgtactacgtgcttgttttggattattacacatacatatagctctttttcgtacatct

SEQ ID NO: 5990 - DNA, 683 bp, Artificial
  Synthetic
gcccacgcgtcgcccacgcgtcgcccacgcgtcgctcatcagcaacgaaccaagtcacaccgatcgatcgagcaacagtagtaggaaccatggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccagggtgagctgagctatcgatcggatggatcatttatatgcatacagaagcgcgacggtgggtcgatgtgtggagccgatcgaattctgtatccaatattagtagtatctgtacgtattctggaataaaaagatgagctagctaaggtcgatcaatcaccatgcatgcatgtgtgtgcatccatggttgatcggcccggccggtcaggctagctagctttcttcttcttgtgtgttcatctcgtacgttttgctc

SEQ ID NO: 5991 - DNA, 1822 bp, Artificial
  Synthetic
aaatttgattgaagccggagaaaatggcgatagggagcttagcaagacgaaaggccacaacaattttatcttctagatatctctatagcacatccaaatattcattttctcttaacagaaattactcttcgggatctgatgaaaacgacgtcgttgttatcggcggtggacccggcggctatgtggcggcgattaaagctgcacagcttgggctcaaaactacttgtattgagaaacgtggtacccttggtggtacctgtctcaatgttggttgtattccttctaaggcacttcttcactcctcccacatgtaccatgaagctcaacattcatttgctagtcatggtgtgaagttctcttccgttgaggtagatcttcctgccatgatgggccaaaaagataaagctgtggctaacttaacacgaggtattgagggtctattcaagaagaacaaagtgaactatgttaagggctatggcaaattcctttctccttctgaagtttctgtcgacactgtggaaggtggtaatactgttgttaaggggaagaatattataattgccactggttctgatgtcaaaagtctacctgggctaactattgatgagaagagaattgtatcatccactggagctttagctttgaccgaagttccaaaaaagctggttgttattggtgctggctacataggccttgaaatgggatctgtctggggccgtcttggctcagaggtgactgttgttgaatttggacctgatattgttccatccatggatggtgaagttcgcaagcaattccaacgttctcttgagaagcaaaagatgaagttcatacttaaaactaaggtagtatcagttgagactgttggcgatggtgtgaagttgacccttgaacctgcagctggtggtgatcaaactactcttgaggctgatgttgttcttgtttctgctggtagaattccgttcacttcagggcttggattggacaagataggtgttgaaactgacaaggctggtcgaatcttggtcaatgaacgttttgcaactaatgtcccgggggtacatgcaattggtgatgtcattcctgggccaatgctggctcacaaggcagaggaggatggtgttgcttgtgtggaattcattgcaggcaaggagggtcatgtggactacgatttggtccctggtgttgtttacacgcacccagaggtggcttctgttgggaaaactgaagaacaagttaaggcacttggcgttgattatcgtgtaggaaaatttcccttccttgcaaacagtagggccaaggcaattgatgatgctgagggaattgtaaaagtacttgctgagaaggagactgacaaaatcttgggtgttcatattatgtcaccaaatgcaggggagcttattcacgaggctgtcctggctttgcattatggagcatcaagtgaggacattgctcgtacatgccatgcacatccaacaatgagtgaggctctgaaagaagcagccatggccacttacgacaagcccattcacatataaaaatagtgtcatatatttgtttttgtttttcctctgagtatcttgaatacttagagcatattttctaattgccacctcatcactcaagtatctcttgaacagatatttcctccctcttctctaattatccaaagtacttccaacttaatgtttctgttctgcatattcatatctgtaataaagtcaggagctgtatgtcaaagtttaaatgccatcgatttgagtttcattgagttttgatcagcgttgagcacaaaacaaaaaacaaaaaaaaaaaagggggg

SEQ ID NO: 5992 - DNA, 539 bp, Artificial
  Synthetic
gattcgcttgggtcctcgcattgctcggcggcttgccatggccatggcgggaggcagggggaggagcgccgctctcggattgggtcggctcctgtacacgaggaatggcttcatcggtcgcttgggtgtgaggggctttgcgtccggcggcgaagagaatgacgtaattgtcatcggcggcggacctggcggatacgttgcggcgatcaaggcggcgcagctgggattcaagacgacctgcatcgacaagagaggttccctcggcggcacttgcctcaacgtcggatgcatcccttccaaagcactgctccactcgtcgcatatgttccacgaagccaagcacacattctccaagcacggcgtgaagctgtccggtgtggacatcgacgtcgcacccatgatggcgcagaaggagcaggccgcgtcggggctgactaagggaatcgagggcctgttcaagaagaacaaggtgacgtacgtcaaaggcagcggcaagatcgtgtcccccaacgacgtgtctgtggagacgctcgactcgg

SEQ ID NO: 5993 - DNA, 1083 bp, Artificial
  Synthetic
caatctcggcaaatcttcatcatcgtcatttaaatattcgttttcagtttcaagaggttttgcttctggatcggctactgatgagaacgatgttgttatcattggaggtggtcctggtggttatgtagcagcgattaaggctgctcaattaggtcttaagaccacttgtattgaaaaacgtggtgctcttggtggtacttgtcttaatgttggttgtatcccttctaaggcccttttacactcctcccacatgtaccatgaagccaagcatgcatttgctaatcatggtgttaaggtttcaaacgtggaagttgatttgcctgcaatgcttggtcagaaagataaagcggtttccaatctcactcgaggtattgaaggcctcttcaagaaaaacaaggtaacatatgtcaagggttatggtaagcttatctctccatctgaggtctctgtcgaaaccattgaaggggaaaacactgttgtcaaaggtaaaaacattataattgcaacagggtcagatgtgaaacctcttccaggtataactattgatgaaaagaagattgtttcatcaaccggagctctatctttatcagaaatccccaagaaacttgttgtcattggagcaggttatattggtctcgagttaggttccgtctggggcaggcttggatcagaggtgactgttgttgagtttgcgtctgacattgtcccctccatggatggtgagattcgcaagcaatttcagcgttcccttgaaaaacagaagatgaagttcatgctcaagactaaagtggtaggagtagactcatcaggtgaaggcgttaaattgacattagaaccatcagctggtggagatcagaccacactcgaagctgatgttgtcctcgtctccgccggtagatctccatttacagctggtctaggactagatgagattggtgtggagatggataaaatgggtcgtatccctgttaatgagcgatttggaactaatgtacctggtgtcttcgccattggagatgtcattcctggacccatgttagcacataaagcagaagaagacggagttgcatgtgtggaatacat

SEQ ID NO: 5994 - DNA, 427 bp, Artificial
  Synthetic
acttaaactttttaacatatagaacttgatcaaatagctcttctttgacgacagcagcatctgctgatatctcgattatcgtaggctccacaaagtttccttcaccttcgactgctttacctcccgttagtattttaccaccctgggatttgatgacttcaattcctttctcaaagttcttttttgattcaggagtatgtaatggtcctaacaatgtccctttctcaagaggattgccgattttgacttgtttgtatgaggtaagcagttgctcgagtactttgtcatagacactctcatgcaaaagcagcctacggcaagttgtgcaacgttgaccagcagttccaaccgcagcgaatagaacagatcgagccgctaactgtatatcagcatcgtccatgactatgattgcattgtttacactcaa

SEQ ID NO: 5995 - DNA, 470 bp, Artificial
  Synthetic
  misc_feature (35)..(35): The residue at this position can be any nucleotide.
attctttgtggggttaggggttcgagagattgtanaggatggggatgctttccatcgcagctcttcgacggatccagtccgttgctcgagcaggaggaatccgtttgtcttcgtctgctgcagcagttgccaatgaagagtcatacctccgcctcaaagacaaatcacatgtcacgtggccaaaagtactaaatacatctttggaagagatagacccagaagtcacaaatataattgaactggagaagaatcgccaatggaagggtctggagctcattccttcagagaactttacatcactctcagtgatgcaggctgttggttctgtcatgacaaataaatacagtgaaggctatccgggagccagatattatggaggaaatgagtttatcgatatggcagattcactatgtcaaaaacgggcacttgaggcttttcgcttggacccggcaaagtggggagtgaatgtg

SEQ ID NO: 5996 - DNA, 1133 bp, Artificial
  Synthetic
aattttctctctttcatttcttcctctcaattttcttcttctgccacttttaattttcctctaatggatcccgtttcagtttggggcaacgaacctctctccgccgtagatcccgaaatccatgacctaatcgaaaaggaaaaacgccgccaaagccgcggaatcgaactaatcgcatcggaaaatttcacatcattcgccgtaattgaagctctcggcagtgctttaaccaacaaatactccgaaggaattcccggtaaccgttactacggtggaaatgaatacattgacataatcgaaaacttgaccagaagccgtgctttaacggcttttcatttagatccaacaaaatggggagtaaatgttcaaccctattctggtagcccagcgaatttcgctgcgtatacagctgttttgaatccacatgataggattatgggattggatttaccatctggtggacatttaactcatggttattatacttctggagggaagaaaatttctgctacttcgatttattttgagagtttgccttataaggtgaattcaacaaatggatatattgattatgataggttggaagagaaggctttggattttaggcctaaattgattatttgtggaggtagtgcttatcctagagattgggattataagagatttagagaaattgctgataaatgtggagcccttttgctttgtgatatggctcacattagtggccttgttgctgctcaggaagccgccgatccctttgaatattgtgacttggtcactaccaccactcacaagagcttgaggggtccaagggccggtatgatcttctaccgcaagggccctaagccaccaaagaagggacagcctgaggatgcggtctatgactttgaagacaagattaactttgctgttttcccctcgctccagggtggtcctcacaaccaccaaattggtgctcttgctgttgccctaaaacaggccgcaactcctggttttaaggcttatgctaagcaagttaaggccaatgcagttgctctcggcaactacctcatgagcaaaggatacaaacttgtaactggtgggactgagaaccatcttgtcctttgggatcttagacctcttggtttgactgg

SEQ ID NO: 5997 - DNA, 659 bp, Artificial; identical to SEQ ID NO: 5005
  Synthetic

SEQ ID NO: 5998 - DNA, 591 bp, Artificial
  Synthetic
gttttctactaggcgagtccatgggtggagcagtagcacttcttattcatagattgcaacccaatgaatggaatggagcagttttggtggctcctatgtgcaagatatcaaaggagcttcaaccccctaccattgtaaggtttattttgagcaagcttgccttgattgctcccacttggaagattgtacccacaaagagcattctcgatgtaggttttcatgatgcagacaaacgagagaaggtacacacatggactctaaatttgactaacttaaataaatgcttatgctcttttagtttgacttttcttttattcttatttgtttttccttcaagtcacatggtcacatggtgtgctcaagatccattggctagtgcaccatggggatatgacaaatgattatttcaataaatcacttgcatcatgcatgatcagattcgcaccaatccttacatatatttggacaagcctcatcttaaaacagggttggagttgttgaatgctagcttggacttgcagaaacatcttaatgaggtgtcattgcctttcttggtactacatggcgataaagatgtggtaacagatccta

SEQ ID NO: 5999 - DNA, 575 bp, Artificial
  Synthetic
gcagagcgctgtctgctgccgtgccatgcctgtcgcacagatctgctttcagcaatcacaggcgtgtgcggaatgtttcagccaaggctgcgactgctccggctgtaagttgcagctacgatcaagagaagattctcatcgcaaaccggggcgagatcgctgtccgggtgatccgaactgcgcacgagatggggatccagtgcgtcgctgtgcactcgacggtcgacagggagtctctgcatgtcgagctcgcggacgaggccgtgtgcatcggtgagcctgccagtgctaaatcctacttgaacattcccaatctcttgtctgctgccatgacccggaactgcacaatgctgcatcctggatacgggttcttgtccgagaacgcaaagtttgtggacatgtgcaaagatcacggcttgaacttcatcggcccaaactctgatagtattcgcaccatgggagacaaggcgactgcgagggacacgatgaaaagagctggagttccgactgttcccggaagcgatggtcttgtcgagactactgaagaagccgtccggctagctcacgaaattact

SEQ ID NO: 6000 - DNA, 726 bp, Artificial
  Synthetic
cccctcgacccacgcgtccggtagctttggctccttcaagaattcccacaagcacaaggcttccttccaagaactcatactctttccctactcaatgcctctttaagaaatttgaagtagccgagttctctggtcttcgatcaagtggatgtgtgacattttcgaacaaggagtcttccttctttgatgttgtgtctgctcaactcactcccaagaccacaggatcagctcctgtgaagggagaaactgttgcaaaattgaaggttgctatcaatggttttggacgcattggcaggaatttcctccgttgttggcatggccgcaaagattcaccactggatgtcatcgtcgtcaatgacagtggtggtgtcaagaatgcatctcacttgcttaagtacgattccatgctcggaacattcaaagctgatgtgaaaatagtggataatgaaacaattagcgttgatggaaagcacatcaaggttgtctctagcagggaccctcttaagcttccttgggctgaactcggtattgacattgttattgagggaaccggtgtgttcgttgatggtccaggtgctgggaagcacatccaagctggtgccaagaaagtcattatcactgctccagcaaaaggtgctgatattccgacctacgttgttggagtgaatgaacaagactactctcacgaggttgccaatatcgtaagcaatgcctcttgcaccacta

SEQ ID NO: 6001 - DNA, 565 bp, Artificial
  Synthetic
cccacgcgtccgcaaaccttaacttggattctttctggtcaccatggcttcgggtactttctctgtccccaagggtttcactgaattctcaggattgcgaagctcctctgcttctcttcccttcggcaagaaactttcttccgatgagttcgtttccatcgtctccttccagacttctgcaatgggaagcagtggtggatacaggaaaggtgtgactgaggccaagcttaaggtggccattaatggattcggtaggatcgggaggaacttcctgagatgttggcatggtcgcaaggactctcctcttgatatcattgccattaatgacactggtggcgtcaagcaggcttcgcatttacttaaatacgactctactctcggaatctttgatgctgatgtcaaaccttctggagagactgcaatctctgttgatggaaagatcatccaagttgtctctaaccgaaacccgtctcttctcccttggaaggagctaggaattgacattgtcatcgaaggaaccggagtgtttgtggatagagaaggtgcagggaaacacattgaagct

SEQ ID NO: 6002 - DNA, 510 bp, Artificial
  Synthetic
cccacgcgtccggtagccatggcttcggctactttctctgtggccaaaccatctcttcagggtttttctgagttctcaggacttcgaaactcctctgctcttccctttgccaagagatcttcttccgatgagtttgtttccttcgtcagtttccaaacttctgcaatgagaagcaatggtggatacaggaaaggggtgaccgaggccaagataaaggtagccatcaatgggttcggtaggattggtaggaacttcttgaggtgttggcatggtcgtaaggactctcctcttgatgtcgttgtcattaacgacactggtggtgttaaacaagcatcacatctcctcaaatacgactcaactcttggaatctttgacgctgatgtcaaaccttcaggagactcagctctctctgttgatggaaagatcatcaagattgtatctgatcgtaacccatctaatctcccctggggggaactaggcattgacttagttatcgaaggaaccggagtg

SEQ ID NO: 6003 - DNA, 1184 bp, Artificial
  Synthetic
  misc_feature (1094)..(1094): The residue at this position can be any nucleotide.
ggacgcctgggcggacgcgtgggaaatagttccataaggttatttagttgcatccatggcttcccacgcagctttggcttcttcaagaattccaacaaccacaaggcttccttcaaagaactctcgctctttccctactcaatgcttatccaagaaatttgaagtaaccgaattttctggtcttcgatcaagtcgatgtgtgacattttccaacaaagagtcttctttctttgatgttgtctctgctcaactcactccaaagaccacaggatcaacccctgttaagggagaaactgttgctaaattgaaggttgctatcaatggttttggacgaattggtaggaatttccttcgatgctggcatgggcgcaaagactcgccactagatgtcgtggttgtcaacgacagtggtggtgtcaagaatgcatctcacctgctaaagtatgattcgatgctgggaacattcaaagctgatgtgaaaatagtggataatgaaaccattagtgttgatggaaagcacattaaggttgtttctagcagggacccccttaagcttccttgggctgaacttggcatcgacattgttattgagggaaccggtgtgttcgttgatggtccaggtgctgggaagcacatccaagctggtgccaagaaagttatcatcactgctccagcaaaaggtgctgacattcctacctatgtcgttggggtgaacgagcaagactactctcacgaggttgctgatatcataagcaatgcctcttgcaccactaactgcttggctccgtttgtaaaggtcatggatgaagaacttagtattgtgaagggtacaatgacaacaactcactcttacaccggagatcagaggcttcttgatgcttcacaccgtgacttgaggagagcgagagcagcagcattgaacattgtcccaaccagcactggtgcagccaaggctgtgtctttagtgcttcctcaacttaagggaaagctcaatggcatcgctctccgtgtgccaacacctaatgtatcagttgttgaccttgttgtcaatgtcgcgaagaaaggaattacagctgaggatgtcaatgcagctntcagaaaagctgctgatggtccattgaaaggcgtattagctgtgtgcgatgaaccctcttgtttcagttgacttcagatgctctgatgtc

SEQ ID NO: 6004 - DNA, 810 bp, Artificial
  Synthetic
  misc_feature (751)..(751): The residue at this position can be any nucleotide.
tggactcagcactcaaggttttgtttgccatggcaactgcttctatctatgcctcccctgccatctctcaggtgtctgcgaaggggctttctgagtactcaggtctgaagagtgtcaatggaagtgctttcagcaagagaaacgatgatttcctcgcaacttcctcggtgacgaagtcagcaccgaagaatgcttttgtagtagttgctggggagggcaagatcaaggtggcaatcaatgggtttgggcggattgggcgcaatttcatccggtgctggcacgggcgcaaagactccccccttgacgttgtcgtcgtgaatgatactggcggtgtcaagcaggcctcccacctccttaaatatgactccatgcttggtacttttgacgccaatgttgcggctgccggtgatgatggtatctccatcgacggcaaggttatcaaggttgtctccagtcgcaaccccttggacctcccatggaaggaacttggcatagacctagtgattgagggcacaggtgtgtttgtggaccaagaaggagccgggaagcatatcactgcgggagcaaagaaagtgttgattactgcccctgggaaaggtgcgatccctacttatgttgtgggtgtgaacgagcaactatatagccatgatgatgtcatcatcagcaacgcatcatgcaccaccaactgcctggcaccattcgtcaaggttctcgacgagaaattcggaattgtgaagggcaccatgacaancacccactcatacactggagaccaacgtttgcttgatgcaagccaccgcgatttacgga

SEQ ID NO: 6005 - DNA, 718 bp, Artificial
  Synthetic
agctttttcagagccttgatttgaacccgagaccagggccgagctaggccagccatggcgactgcttcccttgcttcctctcctaagcccacccctctttcccaggtttctggtaaggggctttctgagtactctggattgaagagctccagctgtgtcccctttggaaggaagaatgatgacctcctttccagagttgcacttctcaccactgctgtttctagctctggtgcaaagaggggagtagctgaggccaagatcaaggtggccatcaacgggttcggaagaattggacgaaactttctcaggtgttggcatggtcggaaggattctcccctcgatgtcgtcgtcatcaacgacaccggcggtgtgaaacaggcctcccacctcctcaagtatgactctatgttgggcacctttgaagccgacgtccaagttgccggcgaagatggaatttcggttgatggaaaggtcatcaagattgtttctgataggaacccagcaaacctaccatgggaggcctatggaattgacttagtgattgaaggaactggtgtgttcgttgaccaacagggtgcggggaagcacatcactgccggagctaagaaggtgctcattactgcacctggcaagggtaatatccccacctatgttgtcggtgtcaacgaggaattatacagcccggaggacactatcatcagcaatgcatcatgcacta

SEQ ID NO: 6006 - DNA, 1034 bp, Artificial
  Synthetic
caccttataccttccatatttctttaactttccacaccaaataccacattcttctgctgcatttctaaaaagaacaatggcttcggctgctttctcagtagccaactcttctcttcaggtcagcaacaaaggattctctgaattctcagggctgcgcacgtcatcagctattccattcggaaggaaaaccaacgatgacttgctctctgttgttgccttccaaacctctgttgtgagtgctattaatattggaggagggaacaacaagaggggagtagtggaggccaagttgaaagtggccatcaatggatttggaagaattggaaggaatttcttgaggtgttggcatggtaggaaagactctccccttgatgtcattgccatcaatgacactggtggtgtcaagcaagcctctcaccttctcaaatatgactccacccttggcatctttgatgctgatgtcaagcccgtcggcactgacggcatctccgtcgacggaaaagtcatccaagtcgtctccgaccgcaaccctgtcaacctcccctggggagatcttgggattgacttggtgatagaaggtaccggagtgtttgtcgacagagaaggtgccggaaaacacatccaggccggagccaagaaggtgctcatcaccgctccaggaaaaggtgacatccccacatatgttgttggtgtcaatgctgatctctacaaccctgatgaatctatcatcagcaatgcctcttgcaccaccaactgccttgctccttttgtcaaggttcttgaccaaaaattcggcattatcaagggaaccatgacaactactcactcttacactggtgaccaaaggcttcttgatgcgagccacagggaccttagacgtgcacgagctgcagccctcaacatagttccaacctcaactggtgctgctaaggccgtggcccttgtcctcccaagccttaaggggaagctcaacggcattgccctccgtgtgccaacccctaacgtctcggttgttgaccttgtcgtacaagtct

SEQ ID NO: 6007 - DNA, 446 bp, Artificial
  Synthetic
ggctctctcagcttcccctgctgctgctgctgccaatgtctcgtccatgttctccccttctgtttctcgcatgcagtctgcctctcttgccccacccaagagagtggacatctcagagttcacaggattgaaggcctccccacttgtctctgccagcaatcagagggatagcaactgcctcttcaatgccgtttcacggcaggttgcaaaggcaggaaagtcaggatcaatcaagggagagactatggccacattgaaagtagccattaatggttttggacgcattgggagaaactttctccgttgctggcatggccgggaaaattcaccccttgaggtggttgttgtcaacgacagtggaggtgtcaagaatgctgctcacctcttgaaatatgactccatgctcgggaccttcaaagccaatgtgaaaattgtggatgacaaga

SEQ ID NO: 6008 - DNA, 489 bp, Artificial
  Synthetic
gaattcaaaatggctactcatgcagctcttgcttcttcaagaatggctactaacactagaatttcttccaaatcatcttctcactcttacccatcatctcaatgcttctccaagagagttgaggttgcagatttctcaggattgcgatcaagttcgtccgtaacttacgcaaagaatgcaagagaagcgtctttctatgacgttgttgccacacaactcactcctaagatcgctgcagggtctgcacctattagaggagagaccactgctaagctaaaggtggctatcaatggttttggacgtatcggtagaaatttcctccgatgttggcacggaaggaaagactcgcccctcgaggttgttgttctcaacgacagcggtggtgtgaagaatgcatctcaccttctcaaatacgattccatgctcggaacattcaaggcagaggtgaagatcgtagacaacgaacacatcagtgttgatggtaagata

SEQ ID NO: 6009 - DNA, 572 bp, Artificial
  Synthetic
attcttcttgatctgatcgtcggacatggcgtcgcccatgctctccgccgccaccgtgccactccagggaggcggcttgtcggagttctccggcctgaggagctcgtcgtcgctgccgctgcggcggaatgccacctccgacgacttcatgaacgcggtctccttcaggacccacgcggttggcacgagcggcggggcgcggcgggcgccgacggaggcgaagctgaaggtggcgatcaacgggttcggccgcatcgggcgcaacttcctgcggtgctggcacgggcgcggcgacagctcgcccctcgacgtcatcgccatcaacgacaccggaggcgtgaagcaggcgtcgcacctcctcaagtacgactccacgctcggcatcttcgacgccgacgtcaagcccgtgggcgacaacgccatctccgtcgacggcaaggtgatcaaggtcgtctccgaccgcaacccgtccaacctgccgtggggcgagctcggcatcgacctcgtcatcgagggcaccggtgtgttcgtcgaccgcgacggcgcgggcaagcacatccaggccggcgcca

SEQ ID NO: 6010 - DNA, 797 bp, Artificial
  Synthetic
cccccgagcttgctgctgctgcattcttcttgatctgatcgtcggacatggcgtcgcccatgctctccgccgccaccgtgccactccagggaggcggcttgtcggagttctccggcctgaggagctcgtcgtcgctgccgctgcggcggaatgccacctccgacgacttcatgaacgcggtctccttcaggacccacgcggttggcacgagcggcggggcgcggcgggcgccgacggaggcgaagctgaaggtggcgatcaacgggttcggccgcatcgggcgcaacttcctgcggtgctggcacgggcgcggcgacagctcgcccctcgacgtcatcgccatcaacgacaccggaggcgtgaagcaggcgtcgcacctcctcaagtacgactccacgctcggcatcttcgacgccgacgtcaagcccgtgggcgacaacgccatctccgtcgacggcaaggtgatcaaggtcgtctccgaccgcaacccgtccaacctgccgtggggcgagctcggcatcgacctcgtcatcgagggcaccggtgtgttcgtcgaccgcgacggcgcgggcaagcacatccaggccggcgccaagaaggtgctcatcaccgcccccggcaagggtgacatccccacctacgtcgtcggcgtcaatgccgaccagtacagccccgacgagcccatcatcagcaacgcctcctgcaccaccaactgcctcgcccccttcgtgaagatcctcgaccagaagttcggcatcatcaaggggacgatgaccaccacccactcctacaccggc

SEQ ID NO: 6011 - DNA, 363 bp, Artificial
  Synthetic
cccacgcgtccgaatctttggccaagcaccatggcaacaaccatgaagactgccatctctggcaagactgcgggtctccagaagtctggcgtgaggcccgccagggcctccgtcaagatggaggttgtcgccgagaagaagctcagggtggccatcaacggcttcggccgcattggtcgcaacttcctgcgctgctgggagggcaggtccaacaccctgcttgacgttgttgctatcaacgactctggaggtgtcaagcaggcatctcacctgctgaagtacgactccatcctgggaaccttcaacgctgacgtgaaggtggtcgatgactccaccatctccgtcaacggcaagcagatcaag

SEQ ID NO: 6012 - DNA, 813 bp, Artificial
  Synthetic
aattcggcacgagctctcagttgccaactcttctcttcaggtcagcaacagaggattctctgaattctcagggctgcgcacctcatcagcaattccattcggaaggaaaactaacgatgacttgctctctgttgttgcctttcaaacctctgttattggaggagggaacaacaagaggggagtagtggaggccaagttgaaagtggccatcaacggatttggaagaattggaaggaatttcttgaggtgttggcatggtaggaaagactctccccttgatgtcattgccatcaatgacactggtggtgtcaagcaagcctctcaccttctcaaatatgactccacccttggcatctttgatgctgatgtcaagcccgtcggcactgacggcatctccgtcgacggaaaagtcatccaagtcgtctccgaccgcaaccctgtcaacctcccctggggagatcttgggattgacttggtgatagaaggtaccggagtgtttgtcgacagagaaggtgccggaaaacacatccaggccggagccaagaaggtgctcatcaccgctccaggaaaaggtgacatccccacatatgttgttggtgtcaatgctgatctctacaaccctgatgaatctatcatcagcaatgcctcttgcaccaccaactgccttgctccttttgtcaaggttcttgaccaaaaattcggcattatcaagggaaccatgacaactactcactcttacactggtgaccaaaggcttcttgatgcgagccacagggaccttagacgtgcacgagctgcagccctcaacatagt

SEQ ID NO: 6013 - DNA, 528 bp, Artificial
  Synthetic
cggcgacgcgctcgggggggcgctccagttcttccaggtccagaaggcggggaagctggagaacaaccagatcccgtggaggggggactcggcgctggatgatgggaaaccagcggggctggatctttccaagggaatgtatgatgctggtgatcatatcaagtttagtttcccgatggccttcacggcaacggtgctctcgtggtccatacttgagtatggagatcagatgagcgccgcgaagcagctggaccctgcgcttgatgcgctccgatggatcactgatttcctcgtcaatgcgcatccatctgacaatgtgttctacattcaggttggtgatcctgatctagatcacaactgctgggaaaggccggagactatgtctgagaaaagaccactcacacagattaacacaaagtctcctggatcagatgttgctgctgaggcagcagcagctatggcatcagcatcaattgttttcaaatccagagacactacatattctgattcacttcttcaacatgctca

SEQ ID NO: 6014 - DNA, 605 bp, Artificial
  Synthetic
ttgggcatagtgtagtgtgtatactcagtccaaatggcctgcttttactacctttcttgttccaagctagctttacttgttctgctctgcttcactacctctctgcttcattgcagtgcccaccctgaccaccatggccgtcatcctcgctttgcctcgcacaattacagagatgctctcaccaaatccattcttttctttgagggtcagagatcaggcaagctccctcctaaccagagaatcacttggcgtagaaactctgctctttcagatggctccgcattgcatgttgatttggttgggggatattatgacgcaggagacaatgtgaagtttgggttcccaatggcattcactaccacaatgctatcatggagtgtgattgagtttggtggactgatgaaaggagagctccagaatgcaagacaagccattcgctgggctactgactatcttctcaaggccactgcctatccagacaccatatttgttcaggtgggggaagcaggaagtgaccatgcttgctgggagagacctgaggatatggacaccccaagaagtgtattcaagattgacaaaaacactccagggtctgaagttgctgc

SEQ ID NO: 6015 - DNA, 695 bp, Artificial
  Synthetic
aaaaatactccaaattccgcttttcttatttattcctttaacctacattgtctatttctaatactataattcttcattttgttaagatcacattttcttttatcccgcattgctacatgcggggatcattaatcaggtaatttcgtgagtgaataaggaaatgggagagaaatcaagaaaaggaggttggtgtggttggattatagttttaatagtggtagcagcggctgctggagccattgttgtacttgttaaaaagaagcataatggttcaagcccagatgctgctcctgttcctggacctcctggttctcctaccaagaaatatgcagatgctttgaaaactgcaatgcagttctttgatgtacaaaaatctgggaagttagtaaataataaaatatcatggagaggtgattcagctgtcaaagatggaagtccagcaaagttggatctcagtaaaggaatgtatgatgctggcgaccacatgaaatttggattccctatggcttacactgccactgtgttatcgtgggccatccttgagtacggtgatcagatgaaggttgtggaccaactggaacctgctcaagactcactcaagtggattaccgactaccttatcaatgctcatccaaaagataatgttctttatattcaggtgggtgatcctgatgccgaccatagatgttgggata

SEQ ID NO: 6016 - DNA, 704 bp, Artificial
  Synthetic
agcaaagctggctgttgggtccaacggagcagaagaagaagaagtatgtggatcttggttgtattattgtgagtcggaagattttcaagtggactgtgggctgtattcttgccgctgcgcttttagctggattcattactatgattgttaagcttgcacctagacacaaacaccacaaccccccacctgataattataccgtcgctctccataaagccctcatgttcttcaatgcccagaaatctggaaaattgccgaagcacaacaatgtgtcatggagggggaattcatgtttaaaagatggccagtcagatgattcaactatgttcaaaaatttggttgggggatattatgatgcaggagatgcaatcaagtttaatttccctcagtcgtttgctctcaccatgttaagttggagtgtgatcgagtatagtgcaaaatatgaagctgctggtgagctcgctcatgttaaagatattattaagtggggtactgattatctcctgaagaccttcaattcctctgctgataccatagaccgcattgctgcacaggttggaaaaggggatacttccggagggagtactgatcacaatgatcactattgttgggtgcgtccagaagatattgattacgatcggcccgtgactgaatgtcacggctgctcggaccttgctgcagagatggctgctgctctggcttct

SEQ ID NO: 6017 - DNA, 675 bp, Artificial
  Synthetic
gggcaaaaaacagatctacatagttaagttttttagctcacaccatattacttgtcgaccgcgtaacaatgaagggttttgtggtttgtttgtttttagtaattggggttcttcctttagcatttgctggccataattatggtgaagcactaagtaagagctttctgttttatgaagctcaaagatctggttatcttcctcataatcaaagggttaattggagaggacattctggtcttaatgatggaaaagctagtgggattgatttggtgggagggtactatgatgcaggagacaatgtgaaatttggtttgcctatggcatttactataacaatgatgtcatggagtattttagaatatggtaggcaaatgggtgctagtggtgaacttggtcatgctatggatgctgttaaatggggtactgattatctcctcaaagctcaccctgaaccttatgttctttatggagaggtgggagatggtaacacagaccattactgttggcaaagaccagaagatatgtctacatcaagagctgcttacagaattgacccgaaccatccgggttcggaccttgccggagagactgccgccgccatggccgccgcttccattgtcttccgccgctacaaccctggctatgctaatgagctacttaaccatgcccatcagc

SEQ ID NO: 6018 - DNA, 541 bp, Artificial
  Synthetic
taggtagacgtttagcaggtgtgttgttggttttggtttgggggggctggggtttttagagtatacttttcagttaggcagtttccaaaatggcttcttcttccacatttgccatagccactttcctttttctgctatgcttcactactcctctgtttcttgccaaacctcaacaccatcctcgctttgcttctcataactatagagatgctctcgccaaatccattatttattttgagggtcagaggtcagggaagctcccttctaaccagaggatcacttggcgcaaagactctggcctttcagatggcaaagccatgggtgttgatttggtaggtggatattacgacgctggagacaatgtgaagttcggtttcccaatggcattcacaaccacaatgctgtcatggagtgtgcttgagtttggtggattgatgaaaggagagctacagaatgctaaagaagccattggttgggctacagagtatcttctcaaggccactgcccatccggacaccatttacgttcaggtgggggatgc

SEQ ID NO: 6019 - DNA, 377 bp, Artificial
  Synthetic
gcatactggtcattgattggttaatcagagctctctcttttcttttcctatctctagagactagagaaatggctctctatctctcttcttcacgactcatcacctttctctctttcatcttgcttctctccaatggcttctcgtcctcttcctctcgccctagcatccaccatcgtcaccacctggacaaccacaattacaaagacgctctctccaagtccattctcttcttcgaaggtcaaagatccggaaagcttcctccaaaccagagaatgacttggagaagcaactctggtctctctgatggctctgctctcaacgtggatttggtgggaggatactacgatgcaggggacaatatgaagtttggattccca

SEQ ID NO: 6020 - DNA, 711 bp, Artificial
  Synthetic
gtcagttgagagcaattcaaaggatcgacgacaatggcttctcagattgcgagaagacttctacgtagccgcggtaattcgtcgtttaggtatttggatcggagcttcagttcggagtccaattcgaatttgattcgcgctactcttttccccggcgatggtattggccctgagatcgccgattccgtcaggcaggttttcaagactgctgaggtaccaattgaatgggaagaacactatgtggggaaggagatagaccctagaaccaatagttttctaacatgggagagtcttgaatcagtgagaaggaataaggttggtttgaaagggccaatggccacgcctattgggaaaggtcatcgttccttgaaccttacattgaggaaggagttaaatctatatgccaatgttagaccttgctacagcctacctggatacaagacacgctatgatgatgtcaatctcatcactatcagggaaaacactgaaggagagtacagtggccttgaacatcaagtcgtaaggggtgtggtcgaaagtctcaagatcatcactcgtcaagcaagcttaagggttgccgagtacgcatttcactatgccaaggctcatggaagagagagagtgtctgcaattcacaaagctaacatcatgcaaaaaactgatggtcttttccttaagtgttgccgagaggtagcagagaagtaccctgag

SEQ ID NO: 6021 - DNA, 951 bp, Artificial
  Synthetic
cacacaccctaatatccatgccccaaatttaatagtcaaacctctcaaccccatcgatccatttccgatcaatggcgaaacgagccctacccgttctcaagcacctcctcaagtcctcatccccatccccatccccatcccatgggttttcccattcattaacgtcagcccgatcggtcacctacatgccccgacccggtgatggcacaccacgcgccgtcactctcatccctggtgacgggatcgggccgcttgtcaccggcgccgtcgaacaagtcatggatgcgatgcacgctcctgtgtatttcgagcgatatgaggttcacggcgacatgaagagtgtgcctccggaggttatggaatcgatccgtaagaataaggtttgtttaaaaggagggttgaaaactccggtggggggtggtgttagttcccttaatgttcagcttaggaaagagcttgatctatatgcttcccttgttcactgcttcaacttgcaaggattaccgactcgccatgagaacgttgatattgttgtcattagggaaaacacggagggtgaatattccggcctcgagcatgaggttgttcccggtgtcgtggagagcctaaaggtgatgacaaagttttgctcggaacgaattgcaaaatatgcctttgaatatgcatacctcaacaatcgcaaggtagtgactgctgtgcacaaagcaaacattatgaaacttgcagatggtttatttttggagtcttgtcgtgaggttgcaagcaaatatcctgatcaagtacaatgagatcattgaggataactgttgcatgcaacttgtatcaaggactgagcaatttgatgttatggtcaccccaaatctctacggaaatctggcggcaaatacggcagctggtattgctggaggcactgatgttatgcctggaggcaatgcgggggctgaccatgct

SEQ ID NO: 6022 - DNA, 672 bp, Artificial
  Synthetic
gttcaactacagcactaggtccggcggcgggacgatcactgcaactttgttccccggcgatggaattgggccggagatcgccgaatcggtcaagcagattttccaggccgctggcgtgcctatcgaatgggaagagcacttcgttggaaagtcagtggatccaaagaccggaagctttgtcacatacgatagcatggagtctgtgcgcaagtatgggatcggtctcaagggcccgatggctactcccattggaaagggccacaagtcgctcaacttgacgctacggaaagagctcgggctgtatgccaacgtcagaccgtgcctcagcattcccggctacaaaacacggtatgacaacgtcgatctggtcaccatcagggagaacactgaaggagagtacagtggtttggagcaccaagtggtgaaaggtgttgtggagagtctaaagattatcactcgccaagccagcatgcgtgtcgcagagtatgcgttccactacgccaaaacgaacggcaggaagcgtgtgtccgcgatccacaaggcaaacatcatgaagaaaactgatggattgtttctacagtgttgtcgagaggtggcggagcaaaaccccgagatcgtttacgaggaggtcatcatcgacaactgttgcatgatgcttgtcaagaaccccgc

SEQ ID NO: 6023 - DNA, 649 bp, Artificial
  Synthetic
cgcttcttcttctatatattctcgagatatatacgaacactcatcgtcacaatgctggccattcgctctctctccaaccctgccaggcactgcctgcgagcagctccccgcgctgccgccacctggtccgtttcgaacaagcgattctactcccaggagcgtgttgcaaagtatgagggaaccaaggactccaacggcaacttcctcgtcagcttaatcgagggtgacggtatcggtcctgagattgcccagtccgtcaaggacatcttctccgctgccaagaccccaattgcttgggagcccatcgatgtcacccccatcatcaaggacggcaggaccgccatccccgacgccgccattgagaacatcaacaagaacaagattgctctcaagggtcctctggctacccccgttggcaagggccacgtttccctcaacctgactctgcgacgaacctttaacctgttcgccaacctgcgaccttgccgatccgtcgccggcttcaagaccccctacgacggtgtcgacactgtcctgatccgagagaacaccgagggcgagtactctggcattgagcacgttgtcgtcgacggtgttgtccagagcatcaagctcatcaccgaggaggcttccgagcgtgtcctgcgat

SEQ ID NO: 6024 - DNA, 712 bp, Artificial
  Synthetic
aagagggaagaagaaggaagcgcatcgtaaatcgagggctttacgaatggattctcttgcatggtttttatttttgtgtgttgtcgagcaggtccttttagttttttgaaagaaaaattatagatgggagacggagatgatgctccagataccagtgcgattcccgctgtgattgctacttcgagcaccactgaagtgtctgtggtggttccatgctcgatccaagacggtcaaaaggactcgcctttggtggttccgtgtgctattccagcacaccaagaagctgtgcaagacagggactataagttcctctccaaggctgtggacgaggcctacaaaggcgtccattgcggcgatggcggtccatttggagctgtggtcgtccaaaacaatgagatcgtcgtcagctgccacaacatggtgctcaggcacactgatcccacggctcatgccgaagtcacggctgttcgagaggcatgcaagaagttgaaccgattcgagctgtccgactgcgagatatttgcctcttgtgaaccatgtccgatgtgcttcggagcaattcacttagcacgaatcaaacgcctggtgtatggtgccaaagccgaggccgccatcgcgattggcttcgacgacttcatcgccgacgctatccggggcacgtcttactaccaaaaggcaaacttggagattaaaagagcggacggaagcgttg

SEQ ID NO: 6025 - DNA, 356 bp, Artificial
  Synthetic
cccacgcgtccggcataataacgaggttgtcgctagctgccacaatatggttttgaaatatactgacccaactgcacatgctgaagtcactgccattagagaggcatgtaagaaacttaacaaaatcgagttatcagaatgcgagatttacgcatcttgtgagccatgtccgatgtgcttcggagccatccatctctcgagactcaagaggttggtttatggagccaaagccgaagcagctatagccatcgggtttgatgacttcatagctgatgctttgagaggcacgggggtttaccagaaatctagtctggagatcaagaaagcagacgggaatggcgctgcgattgcggagc

SEQ ID NO: 6026 - DNA, 278 bp, Artificial
  Synthetic
gaattcaagacgaaaagaaagaaaagaagaaggggaaaaacaaagatggcgaagaggacagcaaggatgaaaagaagactaaagacaaagatgaaaaatcaaagaagaaggagaaggatgaaggcactgacatgaaagaagaaaaaaagaaggacaaggaagggaaggagaaagatggaaaggagaagaaagaaaaagaaaagaaggacaagagcaaagatgagaaagatggcagcagcaagaagaaagaaaaggatggggaatcaaaggaaaaaaaa

SEQ ID NO: 6027 - DNA, 591 bp, Artificial
  Synthetic
ccccccgggcaccaagaccaggtagccgcagagagaggagagcgcgagcagagcaagcaaccaagcagcagcagcgatggccgacgcagccacgacatcctcccacctgctcctgctctcccgccagcaggcggcggcctcgctccaatgcggcctctccttccggaggcagcccggcaggctcgccggtgggtcgtcggccccgagcgtgcggtgcatggcggccgtcgacacggcctcggcgcccgccgcgacggaggctagcaagaagagcagctacgagatcaccacgctgacgacgtggctgctgaagcaggagcaggccgggaccatcgacggcgagatgaccatcgtgctggccagcatctccacggcgtgcaagcagatcgcctcgctggtgcagcgcgcgcccatctccaacctcaccggcgtccagggcgccgacaacgtgcagggcgaggaccagaaaaaactcgacgtcgtctccaacgaggtgttctccaactgcctcaaatagagcgggcgcaccggcgtgatcgcgtcggaggaggaggacgcgccggtggccgtggaggaaagctactcgggcaa

SEQ ID NO: 6028 - DNA, 564 bp, Artificial
  Synthetic
tatttcttggcgatggcggcatcgtcggccacgcattgcctcaccgatccatccaccaagatcatcaatgcgctggccaagaacacgattcgatgctccgtgtccatcgccggcggcagggatttcgccaggaatcgtgcgttccagcagcagcattgtagaaatccagggatcagggcggcggtgagcgtggaatcggccacggagaagaaggcgagcagcggcggcgctgggaaataccagctcaacaccctcacgaactggctgctcaagcaagaacaggcagggatcatcgatggtgagctcacgatcgtcctctccagcatcacggtcgcttgcaagcaaatcgcggcgctggtccagcgggctggaatctcgaatctcaccggcgtccagggcgccgtcaacgtccagggcgaggatcaaaagaagctcgatgtggtctccaacgaggtcttctcgaattgccttcgatccagtggccggacggggatcatcgcgtccgaggaggaggacacgccggtggcggtggaggagagctactcgggcaactacatcgtggtg

SEQ ID NO: 6029 - DNA, 567 bp, Artificial
  Synthetic
cccctctctcaacaagtccatcacatttcacaatggaagccaaccccgaagtccagaccgatatcatcacgctgacccggttcattctgcaggaacagaacaaggtgggcgcgtcgtccgcaatccccaccggagacttcactctgctgctcaactcgctgcagtttgccttcaagttcattgcccacaacatccgacgatcgaccctggtcaacctgattggcctgtcgggaaccgcaaactccaccggcgacgaccagaagaagctggacgtgatcggagacgagatcttcatcaacgccatgaaggcctccggtaaggtcaagctggtggtgtccgaggagcaggaggacctcattgtgtttgagggcgacggccgatacgccgtggtctgcgaccccatcgacggatcctccaacctcgacgccggcgtctccgtcggcaccattttcggcgtctacaagctccccgagggctcctccggatccatcaaggacgtgctccgacccggaaaggagatggttgccgccggctacaccatgtacggtgcctccgccaacctggtgc

SEQ ID NO: 6030 - DNA, 318 bp, Artificial
  Synthetic
gaattcagtatcaatcagttgattcagaggtaattgtctagctatggtcggatcaattgcagcaacggcttctcatcagcttctattctctagcactactacctctgctcaccgctcctcatcatcatatgcatcatcctctgctcgagtactctttgatgtctctaagcagttgacgtccccaatcagcagcaccagaaaattatcactgagtaatgaagtcaggtgtggcgcagttgggacaacaacacctgagactgcaacggtaaccccaacaaggagcaagtatgacatagtgactttaacaagttggttatt

SEQ ID NO: 6031 - DNA, 745 bp, Artificial
  Synthetic
tttaagtgaaaaatttagcaatcacaagtaaaagcaattccatgaaaatcacaatggcagcatcatcagcaacagcaacaacttcatttctatgtgctttagataaaaagactccatttttatgtactctagacaaaaagggaactcaatttctatgcccaaaaggcaacagcacaaagagaaggtcatttaatggaggagtgaagtgcatggcaatagaaacagcagcaggggctacagagacaaggaaaagaagtggctatgagttgcaaactttaacaagctggctattacggcaagaacaagctgggactattgatgctgaacttaccattgtgctttcaagcatttctatggcttgtaagcagattgcttctttggtccaaagagctggaatttctaaccttactggagttcaaggtgctgtcaatgttcaaggagaagaccaaaagaaacttgatgttgtctctaatgaggtattctcgaattgtctaaggtcaagtggaaggacagggattatagcatcagaggaagaggatgtaccagtggcagtggaagagagttactcaggcaactacattgtggtgtttgaccctcttgatggatcatcaaacattgatgctgctgtttctactggttctatttttggaatatacagcccaaacgatgagtgcctcgcagatcttggagatgattccacgcttgacaatgttgaacagaggtgtattgtgaatgtatgccaacc

SEQ ID NO: 6032 - DNA, 558 bp, Artificial
  Synthetic
aaagaaatgactgaagctattccaagatttacttggaacaccatattctcaagctcttcttccatttctcgtctctctcctaatttccatctccttcccaccaataccaagagatcacaacagctgagtaatggcaatttcagttctagttccaattcaagaatttgctgcgaagcagcaagcttggatggagcaaaaacagccccaacacagatcaagaaaccgataaaccgatatgaaatggttaacttgacaacatggctgttgcggcaagaacaagcaggcaacattgatgcagaattagccatagttctttcgagcatatcgttagcctgcaagcaaattgcttcacttttacaaaggtcaagtattgttaaccttactggagctcaaggcactgttaatatccaaggtgaagatcagaaaaaacttgatgtagtatccaatgagttattctgcaattgtctaagatcaagtggaaggacaggaattatagcatcagaggaagaagatgtaccagttgcagttgaagaaacttattctggaaattatattgta

SEQ ID NO: 6033 - DNA, 713 bp, Artificial
  Synthetic
tccgcaatatttaatatctggttgccggagagtttgccggaaaatcaagaaaaggtagcgatggatcactcggcggatgcacataggactgatttgatgaccataacaaggtttgtgttgaatgaacagagtaagcatcctgaatcccgtggtgacttctctatcttgctcagtcacattgttcttggctgcaagttcgtctgcactgctgttaacaaggcaggtctggcaaaactcctagggcttgctggtgaaactaatgtgcagggagaagatcaaaagaaactggatgtactctcaaatgaagtatttatcaaggctctggttagcagtggccgaacatgcgttcttgtatctgaagaagacgaagaggctacatttgtggagccagctaagcgtggaaaatactgtgtagtctttgatcctcttgatggatcctcgaacattgattgtggtgtttctattggaacgatcttcgggatttacatgatcaaagacggtcatcaaccaacactagatgatgtcttacaacctggaaagaacatgttagctgctggatactgcatgtatggaagttcttgtacgctagttttgagcactggatctggagttaatggttttacccttgatccctctcttggcgagttcattctaactcatcctgacatcaagattcctaagaaagggaagatctattcagtaaacgaagggaa

SEQ ID NO: 6034 - DNA, 747 bp, Artificial; identical to SEQ ID NO: 5000
  Synthetic

SEQ ID NO: 6035 - DNA, 265 bp, Artificial
  Synthetic
cgaaaaatggcgatggccatggctcttcgagaggctttcttcttcaattgacaaacccattcgtcctcttattcgatccacttcatgttacatgtcttctttgcccagtgaagctgttgatgagaaggaaagatctcgtgtcacttggccaaaacagcttaacgcacctttagaggaggttgatcctgagattgctgacattattgagcatgagaaagctaaacaatggaagggacttgaacttattccatctgaaaacttcaca

SEQ ID NO: 6036 - DNA, 742 bp, Artificial; identical to SEQ ID NO: 4985
  Synthetic

SEQ ID NO: 6037 - DNA, 1158 bp, Artificial
  Synthetic
caggggagaagctgacaataattatggccatggcaacggctcttcgaagactctcctcttctgttgacaaaccaattaagcgtctctataatggcggctctctctattacatgtcatcgttgcctaatgaagctgtttacgagaaggaaaaaaatggtgtcacgtggccaaagcaactgaatgctcctctagaggaggttgatcctgaaattgctgacattattgagcttgagaaagcacgccagtggaagggacttgaactcattccttcagaaaatttcacttctgtgtctgtaatgcaagctgttggatccattatgacaaacaagtacagtgaaggatatcctggggctagatactatggaggaaatgagtatattgacatggcggaaacattatgccagaaacgtgctttagaagcattccggttggatcctgcaaaatggggagtgaatgtgcagcctctatcaggatcacctgctaattttcatgtttacactgcacttttaaaacctcatgaaagaatcatggcccttgatcttccccacggtggacatctttctcatggatatcagactgatacaaagaagatatctgccgtctctatattttttgagaccatgccatacagactgaatgagagcactggctacatcgactatgaccagcttgagaaaagtgccacactctttaggccaaagttaattgtcgctggtgctagtgcttatgcacgtctttatgactatgcacgtatccgaaaggtttgtgacaaacagaaggctgtcatgttggcagatatggctcatattagtgggttagttgcagctggagtcatcccatcaccatttgattatgcagatgttgtgactaccacaacccacaaatcccttcgcgggcctcgtggtgccatgattttcttccggaagggtgtgaaggaggttaacaagcaaggaaaggaggtgatgtacgactatgaagataaaattaaccaggcagtctttcctggacttcaaggtggtcctcacaatcatacaattactggcttggcagttgctttgaaacaggcaatgactccagaatacaaagcttaccaagagcagtgccttagcaactgctcaaaatttgcccagactttagcgggaatgggttatgaacttg

SEQ ID NO: 6038 - DNA, 1204 bp, Artificial
  Synthetic
gaattcgagagaaatctttttttggggttgagaggagagagagagacacacagagagaaaaaatggcgatggcaatggcacttcgtaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctggaattgattccttcagagaatttcacatctgtgtcggtcatggaagctgttggttctatcatgactaacaaatacagtgaaggttatcctggtgctagatactatggaggaaatgagtacattgatatggcagaaactttgtgccagaaacgtgccttggaggctttccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaaaatatctgctgtatctatattttttgagacaatgccataccgattggatgagagcactggttacattgattacgatcagttggagaagagcgctacactcttcaggccgaaactgattgttgctggtgcaagtgcttattcacgcttctacgattatgcacgcattcgccaggtgtgcgacaagcaaaaagctatattgttggcagatatggctcacatcagtgggcttgttgctgctggtgtcatcccatctccatttgagtatgccgatgtggtgaccactacaacacataaatcccttcgtggaccacgtggggcgatgatattttacagaaagggattgaaggaagtcaacaaacaaggcaaagagatcatgtacgactatgaggacaaaattaatcaagctgtctttcctgggcttcaaggaggtccacataatcatacaattactggattagcagttgcactgaaacaggcaactaccccagaatacaaggcttatcaagaacaagttctcaaaaattgctcacagtttgccaaaaccttgaacgcattgggatatgaccttgt

SEQ ID NO: 6039 - DNA, 673 bp, Artificial
  Synthetic
gagtggctacttacaaacttcgatgctctgccctgtgggtgaaggattctagccatcttgtgtcagccctttctactattcccgagtacctgcgtaacaaggcatcagacttgaatcaagtggtcgactacaaagactggcaaatacctctcggcagacgattcaggtctttgaagctgtggtttgtcatgcgcttgtatggtgcttctggactacggagctacataaggaaccacgtccggcttgcaatgcagttccaaggctttgtgcgtgaagattctcggttccagatcgtagctccttgctcattcgggttgatctggttccggctgaagccgccagacagagatccggacgatggaaggacactcaaagcgacgctgctggaggctgtcaattccactggaagaatgttcatcactcacacagtgctctctggtatctacactctgaggatggctatcggtgctcccactcactcaagaaagacatgtagaggcggcgtggaggctgattcaagaacaggcaaccaggatcttataaatttggtattcatattcatcaacattttgcgaaccatacggaactgagacaaaatatgactgaaatgaggaacatacgggcagcaaaagaattactatgacaaagacgaagaatagatgtccaatgccaa

SEQ ID NO: 6040 - DNA, 737 bp, Artificial
  Synthetic
gtccgcggaaaggatgcaattggaaaactggtggtctattgttctgatcaaactcattctgctttacagaaagcttgccagataggaggaattcatcctgagaattttcggatgctgaaagcagtctcatgcagggattatgctctttctcctgacgcactttcagaagctgtatcacatgacctggccactggtttaatacccttcttcttttgtgctactattggtacaacatcttccactgctgtggatcctttgcttgccctgggaaagattaccaagagtaatagcatgtggtttcatgtggatgctgcctacgctggaagtgcatgtatctgtcctgaattccggcactatattgatggtgtagaagaagctgattctttcaacatgaatgcacataagtggttcctgacaaactttgactgttcagctctctgggtcaaggaccggagtgcacttatccagtcactgtcaacaaatcctgaatttctcaaaaacaaagcttctcaaggaaacttggttgtggattacaaagactggcaaattcctctcgggcgcaggttcagatcattgaagctgtggatggtattgagactctatgggctggaaaagcttcaagcttacataagaaatcatatagaactagcaaggcgttttgaggaattcgttgctcaagaccagaggtttgagattgtcacccctcggaagttctctttggtttgctttcgcttacg

SEQ ID NO: 6041 - DNA, 1015 bp, Artificial
  Synthetic
gaaagaagagagagagagagagagagagagatcaatggcaagcatagccttcgcagcctcctcagcctcggcctccccctccctcgaccacgctagatctcccctcatcctcccccctaaggtctctttcttctcatatgggatcaaaagccaagcctgcgatgctagcactgggtggtcctatactcaaaagggccgactttcaggcatccgggcttctgtttccacagaggctcctgcaaaggtagagaaggtatctcgcaagaatgatgagggcgtaattgtcaacactttcaagcccaagaatccctacactggcctttgccttctcaacactaaaattgttggggatgatgcgcctggggagacgtggcacatggtcttcagcacggaagggatggtagagtacagagaagggcaatccattgggatcatcccacctggtgttgatgctaatggcaaacctcacaaactgaggctctactccattgctagcagtgccttgggtgattttggagacaagaagactgtctctctttgtgtaaagaggttggtatataccaatgacaagggcgaggaggtcaagggtgtatgctccaactacctttgtgatctgaagtccggtgagcctgttttgataactggtcctattggtaaagagatgcttatgcctaaggatccaaatgccaacatcatcatgcttggaacaggaacaggaatagcccctttcagaggcttcctgtggaagatgtttttcgaggaacacgaggattacaaatttaatgggcttgcatggcttttcttaggagttcccactagcagcagtttgctttacaaagaggaatttgagctgatgaaatcaaaaaatcctgacaactttaggctacattttgctgtaagccgtgaacagaagaacgataagggggagaggatgtatatacagacgagaatgggggaatactcggaggagttgtgggagctgttgaacaaggacaacaccctatgtgtacatgtg

SEQ ID NO: 6042 - DNA, 731 bp, Artificial
  Synthetic
ccggccaaacatatccgtccctttccctctcctcagcttcgcgtcaattccagagatcgaaaccctagccaacccctcctcctcctcctcttcctcgcgatccaccggcgatggcctccgccctcggggctcaggcgtctgtcgcggcgcccatcggtgcgggcggctacgggaggagttcctcgagcaagggtagcaatactgttaacttctgcaacaaatcatggattggaaccacattagcatgggaaagcaaggccctaaaatcaaggcatatgaacaagatcttttccatgtccgttcaacaagcaagcaaaagcaaagttgctgtaaaacctctggaattggataatgcgaaggagccaccccttaacttatacaaaccaaaggagccttacacagccacaattgtctcagtcgaaaggcttgtaggccctaaagctcctggtgaaacatgccatattgttattgatcatggtggcaatgttccatactgggaaggacaaagttatggtgtcattcctccaggagagaacccgaagaaacctggttccccaaatactgtccggctctattctattgcatctactaggtacggtgattcttttgatggaaagactgccagtttgtgtgttcgtcgtgctgtttattatgatcctgaaactggaaaagaagaccccacaaagaaaggtatctgcagtaatttcctatgcgactctaaaccaggcgac

SEQ ID NO: 6043 - DNA, 194 bp, Artificial
  Synthetic
aataagattgttgctgatgatgctcctggagagacctggcatatggtcttcactactgaaggggaaatcaagtaccgtgaaggtcaatcgataggtgttataccccctggtgttgatgcaaaaggaaagccaaacaaacttcgattatactcgattgccagcagtgcacctggagactttggagactacaagac

SEQ ID NO: 6044 - DNA, 328 bp, Artificial
  Synthetic
cccacgcgtccgggttactgtctctcctatagagttggaagaccctaaggatcctcctttgaacttgtacaaacccaaggagtcttacaccgctaagattgtctctgtggagcgagtagttggcccgaaagcccctggagaaacttgtcatatcgtcatcgatcatgatggtaaccttccttactgggaaggacagagttacggtgtgattcctccaggtgagaacccgaagaaaccgggagcgccacacaatgtgcgcctttactcaattgcatcaacaaggtacggagatttctttgacggtaaaacagcgagtttgtgtgtacgt

SEQ ID NO: 6045 - DNA, 160 bp, Artificial
  Synthetic
gaattcaaagatcttctatcttttctgatacaatcatcttccccaagaactctgcttacaccggtggtatctctatggcaaacaatgctgtaaccatataatctcaagtgactactaatgaatctgctgcacctgtaaagaacgtataaaagatctccaa

SEQ ID NO: 6046 - DNA, 1207 bp, Artificial
  Synthetic
tggctataggcaagcgcagcttgtccctcaaccggcagatatggcggcggtggcggcgattcattcatcgcattcgctggggcaattgccgctggcagagcgaagcgatcgacttcctgccgccattgcaaccaagtcatcctttcatggaggcaagatcgcattatcagatctaacgtacagctacaggccactgaatggcaaggtctccgtgagagcatcggcagtgtccaccgagactgtggagaaggtgaagaagaaagccgaagaaggtgtcgtcacaaacttgtttaggccaaaagaaccttacatcggtcgttgcctcctcaataccaaaatcgtcggagatgatgcaccaggagagacttggcatatggttttcagcactgaagggaaaattccatacaaagaaggccaatccatcggaattatcccaccaggagtggatgcaaaaggaaagcctcagaagctccggctttattccattgcgagcagtgcccccggggactttggtgattataaaactgtctctctgtgtgtgaagcggctcgtctacttgaatgataaaggagaggaagtcaagggcgtctgctcgaactttctctgtgatctaaagccaggagaggaagtgagcataactggacctgttggaaaggaaatgctcatgccagttgatccaaacgcaaccattatcatgctcggtactggtactggtatcgcacctttcagaggcttcttgtggcggatgttcttcgagaagcatgacgattacaagtttaacgggcttgcttggttgttcctgggagttccaacgagcagctcactgctgtacaaagaggagttcgagaagatgaaagaaaagttcccagacaacttcaagctcgacttcgcagtgagccgcgagcaaaccaacgccaaaggcgagaagatgtacatccagacgagaatggccgagtatgccgaccagctctgggagctgctcaagaaggacaacaccttcgtttatatgtgcggattgaaaggaatggagaaaggaatcgacgacatcatgaccggcctcgcagccaaagacgggattgactggatggagtacaagagacagctaaagaaggcggagcagtggaatgttgaagtctactaaaaacagtgctcgcatttgtcgaaagctcgcaatgtaaactacaccgtacaacgtaattaattttgc

SEQ ID NO: 6047 - DNA, 624 bp, Artificial
  Synthetic
gagttcgatcgatcccatggcgctgcatgctgtgttccagccgggtacagcgtatggtccttccagtggtgtgaattccccgcggtgttcttcgtcatgcatcactgtcaagatgcccttggcggcgcagagattgactctggaccttgcaagctttggcgaggtgaagagagcagtggcaaggagagaatttgtcttccgagtcaacgcgaaggttgcgacggctgctgctccagatctcgagaccgcgagtgacccgccgctgaatctgttcaagcccaagaccccctacactgctaccatcaaatcggtcgagagaattgtgggtgacaaagctcctggtgaaacttgccacattgtgatcgatcatggtgggaacgttccttactgggaaggtcagagctatggagtcattcctcccggtgagaatccaaagaagcctggaactcccaatgcagttcgcttgtactctatcgcctcgacgagatacggtgacgaattcgacggcaaaaccgcgagcctttgcgtcaggagagcagtctactgggatccagaaaccgggaaggaagatccagaaaagaagggcgtctgcagcaacttcctctgcgacagcaaaccgggtga

SEQ ID NO: 6048 - DNA, 994 bp, Artificial
  Synthetic
tagtcatggcaggtgcactcactgctgctgtatctattccagcatccaattcatcgtctctccaaaccagaacttctatgtcttcctcggaacgagtcagcttcaacaagagctgtttgtattctaggaatggctgtgccagcagaagggtgttttctgtcaaagccgaggttactacagacactactccacctcctaaagtagagaagatttcaaagaagtatgaagaaggtgttgttgtcaacaagttcaaacccaagaacccttacactggcaaagttcttctcaacaccaagatcacagctgatgacgctcctggagaaacctggcacatggtcttccacacagacggtgaggttccatacagagaaggacaatcgattggtattattccagagggcattgacaaaaacggaaagccacacaagctgagattatactcaattgccagtagtgctcttggggatctgggagactccaaaactgtttctctttgtgtcaaaaggctggtgtacaccaacgaccaaggcgaagaagtcaagggagtctgctctaatttcctatgtgatttgcaaccagggagtgaggtgacgattactggacctgttggaaaagaaatgcttatgcccaaagaccccaatgccaccattatcatgcttgcaacaggtacaggtattgctcctttccgttcattcttgtggaaaatgttcttcgagaaagatctctcgcttatcttcgataccggtagtgatttcacttggattcagtgtaagccgtgcgtggttgaatgtcacgagcaagaacaaccagtatttgatccttcacaatcaaaaacttattcaaatattacttgcaactcaactgaatgtgcccaacttcggtcagccacttcaattacacctaaatgtagttctccttctacttgcgtctatggaattcaatatggtgatcagtcttactcagttggatactttggttctgaaacaataacatt

SEQ ID NO: 6049 - DNA, 695 bp, Artificial; identical to SEQ ID NO: 5014
  Synthetic

SEQ ID NO: 6050 - DNA, 642 bp, Artificial
  Synthetic
ccccgagtttcttatcccgtttttttaccagggtgctcgtgggataactcttaaatccgccggcgaacactctccctctagtattccgtcactgaatctcgccggagcaataaaatggtagcgtcttccatcaccggaacgtcaattattcctgcctctttccggaagcaaacgtcttcttcgtctttgttttcttctagaacaaatcaataccagttacttttctgcagaagcttaacgaagcgggtagtttctgttctccgaagtccgtattctgattcatcagctattggattgtctaacaagactctgaaaaccccgttaaatctcaatgagcacgaatccagcggtcttaccaattcaagctttggtgttaccgaagcaaaaaaggggaatccacccgtcatgcctgctgtgatgacaccaggggggcctttggatctctctactgtgttattcaggaatcgaattatcttcattggacaaccaatcaactccgcagttgctcagagagttatatcacaacttgtgaccctcgcaactatcgatgaaaatgcagatattttgatctatcttaattgtcctggtggaagtacctattctgtcttggcaatatatgactgcatgtcatggataaagcct

SEQ ID NO: 6051 - DNA, 610 bp, Artificial
  Synthetic
gagaggaagagatttgcagcgttagggtagcggcagctccaaatctctctctcgcgaagacaagggccaccgcatctccggtcgcgaatctggaaatgggagaagccaaggagaacgacacctatcaagaggagcttttggactacgaggaggaagaagaggcggcccccgacgccgttgcagctaaggctgccacagagactgtcaaaaagggatatgttggtattcacagctccggttttagagatttcctgctcaaaccagaacttgttcgggctatcgttgattgcgggtttgagcatccatccgaagtgcaatttgagtgcatcccgcaagccatacttggaatggacgtcatctgccaagcgaagtccggaatgggaaagaccgccgtgttcgtgctttcgacactgcagcagatagaaccactcaaggggcaagttgctgctctggtcctgtgccacactcgagagctagcatatcagatttgccacgagttcgaaagatttagtacataccttcccgatatcaaggttgcggttttctacggtggtgtcaacatcaagacccacaaggacctgctgaaaaatgaatgcccgcacatcgtggt

SEQ ID NO: 6052 - DNA, 628 bp, Artificial
  Synthetic
atttgtgcaacaaggtatatttgataaaaaacaccaattgaaaacaaaatggccgacggactcaccgacatcgattcttcccagatcaccaccaactacgacgaggttgttacctctttcgacgaccttggactcaaggacgagctgctccgaggtatctacggttacggttttgagaacccttcctccattcagcagcgagccatcctgcccgtcatcaagggtaacgatgtccttgcccaggcccagtctggtactggtaagactgccaccttctctatctctgctctgcagaacattgacgagaagattaagaagccccaggctctgatcattgcccccactcgagagctggcccaccagatccagaaggttgtccttgcctttggcgagtacatgaagattgagtgccacgcctgcattggtggtacctccgtcgccgaggacatccgagtcatccaggagggtgtccacgtcattgtcggaacccccggtcgaatccacgatatgattgagcgacgaatcctcaagaccgacctcatcaagatgttcatccttgatgaggccgatgagatgctttctcgagagttcaaggaccccatctacgatatcttcaccaccctccccg

SEQ ID NO: 6053 - DNA, 579 bp, Artificial
  Synthetic
tggacagcctcagcttccctcgttcacatgcgagcaacatcggaacatcgtcttcgatacgtggcattgcaacccaatttccatcgtctctatctgttctctgtcccggcatctcattcgcccggtcgtttgggatttttcttcatcccactcatctttgtctcttctttcttctcccttcagacgcgcccaactcgttagcgcttctcgcaactcagcaaggctttgtccgaattttcaaacaaacgctctccaccaaccaattccaaaatgtcccacgaggaagatctcattgactactccgatgaggagattggcgccaacgagaccgccgccgcctccaacggaaagaagggagaagccgcctccggtaacaatgtcgacaagaagggcagttacgttggcatccactccactggattccgtgacttcttgctgaagcccgagcttctgcgcgctatcggcgactgcggtttcgagcatccttcggaggtccaacaaacatgtatccctcaagctcttctcggaggagatatcatctgccaggccaagtctggtctaggaaagactgccgtcttt

SEQ ID NO: 6054 - DNA, 955 bp, Artificial
  Synthetic
cccccccccgtttcactcatccgccgctgagctctatctatctactagttagtttagtcgtctcgagggtaaattgagctttgtgtgcggttttgaggggagtacatcggcatgaggatccagtgcgacgcgtgcgaggccgcggcggccacggtggtgtgctgcgcggacgaggcggcgctgtgcgcgcgctgcgacgtcgagatccacgccgccaacaagctcgccagcaagcaccagcgcctcccgctcgacgccgcgctccccgccgccctcccgcgctgcgacgtctgccaggagaaggcggcgttcatcttctgcgtggaggacagggcgctcttctgccgggactgcgacgagcccatccacgtcccggggacgctctccggcaaccaccagcgctacctcaccaccggcatccgcgtcgggttcagctccgtctgtagcgccaacgccgaccacctcccgccgccagcgcccaaggggaactccaagccgccggcaagcggcatcgctgctgctgctgctcccaagccggccgtgtccgcggcggcgcaggaggtgccgtcgtcaccgttcttgccgccgtcgggctgggccgtcgaggatctcctgcagctctccgactacgagtccagcgacaagaagggctctcctattgggttcaaggatctggagtggctcgatgacatcgacctgttccatgtccagtcgccggccaagggaggcagcacggcggcggaggtgcctgagctcttcgcctcgccgcagccagcgagcaacatggggctctacaaggcgagcggtgcacgccaaagcaagaagccacgggtggagatacccgatgacgacgaggacttcttcatcgttcctgatcttggatgagatgttgttatgtaacagtaatgctatgcaagtgatgtaattttgtatgtatgcaaagaacactgccatc

SEQ ID NO: 6055 - DNA, 719 bp, Artificial
  Synthetic
  misc_feature (579)..(579): The residue at this position can be any nucleotide.
agaaagaaagcgtctcgcgaagaacagagcgtagggtttggagattctccgccgcgaggtacgatcgatcgattggttctagtcgcggcattctggagtttaggtctagatcgctactccggaagtggagaatgggagggatttgcttggccttcagaatgtggcctgattccagtgagatctagagtggattagagctcgagaggcgcgattagatgcggactttgtgcgatgtctgcgaatcagccccggcgaagctcttttgtgcggcggacgaggccgccctgtgcacgaagtgtgatgaaaaggttcatggatgtaacaagctagctagccgtcatgtccgcctccagcttgcggaagcccgagctgtgcctcgatgtgatatctgcgagaatgctcctgcatttttctactgcggcattgatggaacctcactctgcttacaatgtgacatggatgtacatacgggtggaaagaaaactcacgagagatatctcatgctgggacaaagagtagagccagaagataccggtgtacaatcaaacgatcaccgcggacgtaaccattaccacccgncaaaacgggtggccgtgaccaaatccaacaacagtgacgcccccgctgttgccatcgctgtaggtgatgccgaagcgcagcagtccaagagcgatcaagccgtctcaaacatgatggatcttaactccagacctctacgc

SEQ ID NO: 6056 - DNA, 625 bp, Artificial
  Synthetic
ttcgcgagagagctgggcgatcaatccagattttggaggcgctccacggccggcgccagcgaaatccaggtactcttggtgatttccggggagagatctcgatcgattccgtggcgtgattttggggcggagagatgagggtccaatgcgacgtgtgtgagaaggccgaggcggcgctggtttgctgcgccgacgaagccgcgctgtgtgccgtgtgtgatgccgaggtccatgccgccaacaagcttgccgggaagcaccagcgattgcctttgagcgcctctggaaattctcctagctgcgacgtctgccaggagaaaactggatggtttttttgtgtggaggaccgtgctttgctctgccgggcttgcgatgtctccatacactcgtccaacgcacgggcttccggccacaacaggtttctggtcaccggtgtgagagtggcgctcaatgcgctgtctgcccaagactttctcgaagcaccaatgaccccacgatgtcggcaacccgggaacgcgaactcctcggcttctggagccagctcgtcgggaaattcgctttcggccaatcgcacgcaggaggagaggtttgacagaggagagcccgagactgtcatggaaaagag

SEQ ID NO: 6057 - DNA, 494 bp, Artificial
  Synthetic
aaaacactctctccctctttgttctttcatcttctctaagctctttctctgaacctacgcttctgctaagctattctaagagaagccagactagcaataaactcttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaac

SEQ ID NO: 6058 - DNA, 334 bp, Artificial
  Synthetic
aatacactctctccctctttgttctttcatcttctctaagctctttctctgaacctacgcttctgctaagctattctaagagaagccagactagcaataaactcttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctc

SEQ ID NO: 6059 - DNA, 337 bp, Artificial
  Synthetic
caacacacaatttttcctctttttcttgcgctaaattcgaaagggtatgtcctgaaattaggtgtaagagcaaatagttgagatatattagtaataaagatgaagatccagtgtgatgtatgtgagaaagctcaagctactgtaatttgctgtgctgatgaagctgctttgtgtgctaaatgtgatattgaagttcatgctgcaaataaactggcaagtaagcatcagaggcttcatcttcactgcctctccaacaagcttcctccttgtgatatttgccaagataaagcagccttcatcttctgtgttgaggatagagctctcttttgcaaggatt

SEQ ID NO: 6060 - DNA, 649 bp, Artificial
  Synthetic
cccacgcgtccgtatctatcgactagttagtttagtcgtctcgagggtaaattgagctttgtgtgcggttttgaggggagtacatcggcatgaggatccagtgcgacgcgtgcgaggccgcggcggccacggtggtgtgctgcgcggacgaggcggcgctgtgcgcgcgctgcgacgtcgagatccacgccgccaacaagctcgccagcaagcaccagcgcctcccgctcgacgccgcgctctccgccgccctcccgcgctgcgacgtctgccaggagaaggcggcgttcatcttctgcgtggaggacagggcgctcttctgccgggactgcgacgagcccatccacgtcccggggacgctctccggcaaccaccagcgctacctcgccaccggcatccgcgtcgggttcagctccgtctgtagcgccaacgccgaccacctcccgccgccagcgcccaaggggaactccaagccgccggcaagcggcatcgctgctgctgctgctcccaagccggccgtgtccgcggcggcgcaggaggtgccgtcgtcaccgttcttgccgccgtcgggctgggccgtcgaggatctcctgcagctctccgactacgagtccagcgacaagaagggctctcctattgggttcaagga

SEQ ID NO: 6061 - DNA, 623 bp, Artificial
  Synthetic
cgaccagcgtcgctgtgtgaaggttcttagctacataattctctctctctctctctctccatgtctagcagatgcaacattctaaccagtaccgttatgggttcttagcgaaaggaggataggcagataccttgaaggaagcaatgaaggtgcagtgcgatgcatgtgagaaggctccagcatcactcttctgctgtgcagacgaggcggctctctgtgaggaatgtgatgtgcgcatccatgctgccaacaagcttgctggaaaacaccaacgtgtccctctcatccttcaacccccttccgatgctccccgctgcgatatttgccaggagaggtcagcttacattttctgcttggaggaccgagcacttctttgcagggagtgtgatgtgcctatccattcctccaccaccttggcgacgaaacaccagaggtttctagttgcgggtattcaagtggcattaggcactattgagggtggtgctatgaaatactaatactaatactaatactaataccactaatcagcagccagaaatagcgaaaatgcaagccatgccgctagtttctagctctggaactgccaaaaacacatataagaaggaacggaatgtggcggtttc

SEQ ID NO: 6062 - DNA, 791 bp, Artificial
  Synthetic
gaattcattttccgcaactctggtttatttccggaactctggtttacgttccaagatcaaagcaaaagaaatatctaagtgaaggcaaaccggagtcatcttgaacccagttacatcctcaaaaatacatatttgaatcatcgtgaatgttttaatggagtcgaaaggtggtaaaaagtctagtagtagtagttctttacaatacgaagcacccctcggatactgcattgaagacattcgaccaaacggaggaattgaaaagttcagatctgctgcatactcaaactgcgtgaggaaaccatcctgataggaccttatatgttttcaaacgtagagtaggatttccctatttccagtttaatcttaaatcctgcaaaatataatcttacaaatcaatttctctggctttcttattttcttctttttcttcaataatcacaccaagaaacagtctttcttcttcctccacttaatctttctaaaagctttcaatttcaatcacaatgggtgtctacgctaacccaccatctccaattggtttcgaaggatttgaaaaacgtcttgagattactttctctgaagctccaatttttgttgatccacaaggactcggtctccgagccttgactcgtcctcagattgatacaatccttgatgctgctaagtgcactattgtcgatcaactatctaactcagagtttgactcgtatgttctgtctgagtcgagtctttttatctacccactgaagatgatcatcaaaacttgtggaactactaaacttctgctggcg

SEQ ID NO: 6063 - DNA, 626 bp, Artificial
  Synthetic
cccctgccacttgaagctgtgaagtactctcgtgggacattcatttttcctgaagcacagccctctccacacaagaacttctctgaggaggttgcagtcctgaaccgctacttcagcggtctcaaatctggtggcaacgcatacgtgattggagatcctgcaaagccagggcagaagtggcatgtctactatgccacccagcacccggagcaacctgtggtcactcttgagatgtgcatgactgggctggacaagaagaaagcttctgtcttcttcaagacttctgctgatggacacacaacatgtgctaaggaaatgaccaagctctcaggtatctctgacatcatcccagagatggaagtctgcgacttcgatttcgagccctgcggctactccatgaatgccatccacggccctgctttctcaaccattcatgtgactcctgaggatggcttcagctatgccagctacgaggtcatgggcttcaaccctgcttcccttgcctatggtgaccttgtcaagagggtgttgagatgctttggcccgtcggagttctctgttgcggttaccatctttggtggccgcaaccatgcagggacctgggccaagggggctggatgtcgggg

SEQ ID NO: 6064 - DNA, 754 bp, Artificial
  Synthetic
caaatcctaaacaaacccaaattctctcttcccatccgttattttgccccttaatattctttaattcacaaattcaaagcttttttttccaacagtcttttcttcagattttcttctgttaaagaacagtgaaggaggtcgtactgcgattctacatctgcttatttcaccaatttttgtaggaatcgatgaactaatggactctaaaggtgggaagaagaagtctagtagtagttccttatgttacgaagctccccttggttacactattgaagacgttcgaccaaacggaggaatcaagaaattcagatcagctgcttactccaactgcactcgcaagccatcctgagattatccgtgatctagaataaaccaccaaaggtggttcaagtagatagtagtttttggaattctgttcttctcaactctttttcttcttcatatctcatcctcgtgataatctcttccaaaaagttctccttcccaagtactctctttcaagcaagatggccgtgccagtttctgccatcggatttgaaggatacgaaaagcgacttgagattacctttttcgagttaggaatgtctgatggcccaggatgtggtctacggtctctctccatagaccaattggatgaaattctgacaccggctgcatgcaccatagtgtcttcattggcaaatgatgaagtcgactcttatgtcctttcggagtctagcctctttgtctactcatacaagatcatcatcaaaac

SEQ ID NO: 6065 - DNA, 1595 bp, Artificial
  Synthetic
ttctttcttgttaactcattcggaattttcttcctaacaaatttctaaggtttcatctcttcttcggaattttctgatttattggaggaaaagatcgtgatatatcggagagaataggatttataacaaatttcaaatttatattgcaagtgaatgatctaatggagtcaaaaggtgggaaaaagaagtccagtagtagttccttattttacgaagctcccctcggctacagcattgaagacgttcgaccaaacggtgaagtcaagaagttccgatctgctgcttactccaactgcgcgcgcaaaccatcctgatattccctaagctttcgtccttaacgcgtcaatagacgcaacccaaaaaaaaacaaattttttttctgcgttcagtttcttttgtgccctcactccttttcttccttcttttactactttctgcttttgtgctcattgctcggaacattttcctctttaacttcttttgctgccgtgaaccattttcatcatggatatggccttgccagtctctgccattggttttgaaggttttgagaagaggcttgaaatttctttcttcgagcctggtctgtttgctgatcctaacggaaaaggacttcgatctctctcaaaggcacaattggatgaaattctcggacctgctgagtgcaccattgttgattccctatcaaatgacgatgttgattcctatgtcctctccgagtcgagcctctttgtttattcttacaagataatcatcaaaacctgtggcaccacaaagttgcttctcgcaattccgcccatcctaaagttggctgagaccctgtctctcaaagtacaagacgtgaggtatacccgtgggagcttcattttccctggtgctcagtcttttcctcaccgtcacttttctgaagaagttgctgtactcgatggctattttggaaagcttgctgccggtagcaaggctgtgattatgggcggtcctgataaagcacagaaatggcatgtttactctgcctctgcaggacctattcagtctaatgaccctgtttacactcttgagatgtgtatgactggtttggacagggagaaggcatctgtcttttacaagactgaaggaagctcggctgctcatatgactgttcgatctggaataaggaagatcctccccaattctgagatatgtgattttgagtttgaaccctgtggttattccatgaattcgattgaaggagctgcactctcaaccattcacattaccccagaagatggctttagctatgctagctttgaagcagttgggtatgatatgaaaaccatgaagctgggtcccctggttgagagggtgctggcatgtttcgagccagatgagttctctattgctttgcatgctgatgttgctaccaagttactggagcgtgtttgctctgttgatgtgaaaggctactctcttgctgagtggagtccagaagaatttggcaagggtggttccattgtctaccagaagttcaccagaactccttgctgtggatctcccaagtccgttctgaagggctgctggaaagaagatgaagagaaagaagaaaaggagtagtgtct

SEQ ID NO: 6066 - DNA, 671 bp, Artificial
  Synthetic
gggtttgtgcgcttcgattcagaaatccggatttgggcatgttgtaatggacgccaagggaggcgaggacgattccagcagtagtagtagtagtagttttagctccagattccgctacgagatccccctgggctacgttgtggaggacgttcgtccaaacggaggatttgagaagctccgccgtgctggcttcactgtgtgcgtgaggaagccatcctgacatcccctacaggagcaacccgagtaagaacttagctagagtagcagctcgagtagaagaagtccgggttctacaatttttttctagatttttttttcggttctagcggatgggactggaagtagcttgggtggcggagctccagcccgctggagcaggcttcgaaggattcgagaagaggctggagatcgatttctcgtatggtccgagcagcgatccatccggactgcgatcggtctcccggcaagggttggacaggatgctcaaggcggccgactgcaccatcgtctcgcagctcagcagcgacgagtttgattcctacgtgctgtccgagtcgagcctcttcgtctatcctcttaaggtggtgatcaagacttgcggcactacaaagcttctgaggagcattccggtcttgctggagctggcctcggctctggatctctcggtccgg

SEQ ID NO: 6067 - DNA, 1215 bp, Artificial
  Synthetic
gttcgacctgccggaggcgtgaagaagttccagtctgctgcttactccaactgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctttctatgccacttgctgctgtgaagtactcccgcgggatgttcatcttccccagtgcacagcctgctccccacaggagcttctctgaggaagttgctgtcctcaaccgctactttggccatctgaaatctggtggtaatgcttatgtgattggagatccagcaaagcctggccagaagtggcatatctactatgctactcagcacccggagcaacctatggttacccttgaaatgtgcatgaccggactggacaaggagaaagcttcagtctttttcaagacttctgctgatggtcacacatcatgtgctaaggaaatgacaaaactctcgggcatctctgacattatcccagagatggagatctgtgactttgacttcgaaccctgcggctactccatgaatgcaatccatggctcagcgttttctaccattcatgtgacccctgaggatggcttcagctacgccagttatgaggtcgtgggcttcgacgcctctactcttgcttatggcgacctggtgaagagggtcctcaggtgctttggcccttcggagttctctgttgctgttaccatctttggtgggcatggtcatggtggaacatgggcaaaggagctcaatgctgatgcttaca

SEQ ID NO: 6068 - DNA, 642 bp, Artificial
  Synthetic
acgcgtgggcaccggcacctatagctccgcggccgtcgcgcgccgtaagtgtgtcaactcacacgcgccgctgttggtgggggacttcaatttcaattccggcgtccggtgattttcgtcaccgccagaaattgttagggtttttgggtaagggatatgctaactgtccattgagaagtatttctactactcaaatgggccccgcacctgatcacaaggaggatgatcttcgccgtgaaaaagcatctcctccaccacaaccgccatcgaagtctgagaagttgctgacattgcccacgattttaacaattggccgcgtggctgctgttccgcttcttgtaatcacattctatgtggatagctggtggggcccaactgctacaacagccatatttattgcagcagcaataactgactggcttgatggataccttgctcgcaagatgaacttaggaactgcctttggtgcatttctagatccagtcgctgacaagctaatggttgctgccaccttgatcttgttgtgcaccagaccattggagtccagtgtgtttggacagttgccatggctattaactgtcccttcaattgcgataataggcagggagattactatgtctgcagttcgagaatgggcagctt

SEQ ID NO: 6069 - DNA, 565 bp, Artificial
  Synthetic
cccgcacacccgcgacaagctcagctcggctaggccaagacggtggcgagcggcggcgatctggtgctctgcttgggttgagttcttgattttgccgaggtgtatcgatggagacgacggcggcgaataagctgccgccggggttcaggttcaggcccaccgacgaggagcttgtggtgcactacctccgccgccgcgcgctcggctcccctctcccacccgccgtcgacatccccgatgtccgcctcctcgcgcatgacccctccgacctgcttcctccaggtgagtcatgagccagctcgccgccgtcgcgcggcgtcgtcggagcgtggccggccggcgctgacgaggtcccgtgcgtgcagggtggagtgagcaggagaggtacttcttcacgtgcaaggaggccaagtatgtcaaggggcgccgcgccaaccgcgccacgggcgccgggtactggaaggcgacggggaaggagaagccggtggcggtgtccgtggcggcggcgccgaggagccaggcccgccgccgtcgtcgtcggcatgaagcgctccctcgtgttcta

SEQ ID NO: 6070 - DNA, 662 bp, Artificial
  Synthetic
  misc_feature (587)..(587): The residue at this position can be any nucleotide.
ggggttatgggtatggaaaagcttaattttgtgaaaattggagcggtgagattgccccctggattcaggttccatccaactgatgaagaacttgtggttcagtatttaaagcgcaaggtcttctctttccctttaccagcctctatcatccctgacatagacgttcacaaatctgatccttgggatttaccaggggatttggagcaagaaagatacttttttagcacaagggagatgaagcatttaaaggggaacaggtccaatagagcaaccaactcagggtattggaaggcaactggacttgacaaagaaattgtgagttgcagaggcaaacaacaacaacaacttcttgttggtatgaagaaaactcttctcttctacaaaggaaagcctctccatggttgcagaactgattggattatgcacgaatatcgcctcgccaatcttgtacccaacaacattcctacccaggaaaattgggttctgtgccgcatattcttgaagaagagaggaagcagtaagaatgaagaggcgaatacaactagttgtagagcaggtgcaaagagtaagctagttttttacgattntatgaatagctgcgtaccggcttcttcatcagtgtctggttccagtgggatcactgagttgtctactaatgaatc

SEQ ID NO: 6071 - DNA, 707 bp, Artificial
  Synthetic
cccccattcgagaaatccctcacaacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgcc

SEQ ID NO: 6072 - DNA, 726 bp, Artificial
  Synthetic
aacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccggatttacaacaagaagggcgggctggagaagccgccggccgcggcggtggcggcggcggggatggtgagcaacggcgggggcgtcgagaggaagccgatggtgggggtgaacgcggcggtgagctccccgccggagcagaagccggtggtggcggggccggcgttcccggacctg

SEQ ID NO: 6073 - DNA, 688 bp, Artificial
  Synthetic
agttagagctagagctagagctagggtaatcgcggcagcggctagctgggcttcgccggatccaccgggtgatggcgctggacagggcgatttagggttttatcggattgggcgaagaacgcgctgcgatttcagggtaatcggccttgttcgtcgccatggtggaagctccggagggggaagagagagctgttccggaggagaggcgatggaagctggcggatttcgacatcggcaagccgctaggtcgcggcaagtttggcaacgtctatctcgcgagagagaagaggagcaagtatgtggtggcgctcaaggtgttgtttaagaaccagttacagcagtcccaagtcgagcaccagctacgccgcgagatcgagatccaaagccacttgaggcatccaaacatccttcggctgtatggatacttctatgatcagaatagagtgtaccttattctagagtatgccgctaaaggcgagctgtacaaggagctccaacggtgcaaagttttctctgagaggagagcagccacttacattgcctcattggcgagggcgttaatgtactgccacgaaaaacacgttattcacagggacataaagccagagaatcttctaatcggaatgaagggagagctgaaaatcgcagactttggatggtcagtacatacgtttaaccggaggcggac

SEQ ID NO: 6074 - DNA, 416 bp, Artificial
  Synthetic
tcgaccacgcgtccggccgctcggccggctcctcggccgtggcacgttcgccaaggtctacaaggcctataagttggccaccggcgaggccgtcgccatcaaggtgttcgacaaggaggcggtgcagcggtccggcacggtggagcaggtgaagcgcgaggtggacgtcatgcggcgtgtgcaccaccgccacgtcatccgcctccacgaggtgatggctacgcggtccaggatctacttcgtcatggagtacgcgagcggcggcgagctcttcacccgcctctcccggagcccgcggttcccggagcccgtcgcgcgccgctacttccagcagctgatcaccggcgtggagttctgccacagccgcggcgtgtaccaccgcgacctcaagcccgagaacctcctcctcgacgccc

SEQ ID NO: 6075 - DNA, 596 bp, Artificial
  Synthetic
gaattcgaatctcatcacttatctctctctcaatctctcttttaaatttcaaaaagttcctgaaagaacttcaaaaccatattgagatcttagaaccccaggagaaaaaaatacattcagcgagcgaattgattgatttttcaaatcaattcgctcgtattctggtttatttcagattaacgaatctatttcttgtttgttgaaattatatcaatcacgcatgcctgaattaatcgagatctcatcagaaaattcattatttggcaaatatgagctcggtaaattgcttggttgtggcgcattcgctaaagtttatcacgcaaggaatatcaaaacagggcaaagcgtagcaataaaatgtataagcaaacagaaaatcctcaaaggaggattaatggcacatgtcaagagagaaatcactattatgcgtcgtctccaccataagaatattgtgaagctttatgaagttttggccacgaaaacaaagatttatttcgttatggaatttattaaaggtggtgaattgtttgctaaagtagctaaaggtaaatttagtgaagatttgagtcgtaaatatttccagcaattaatatcag

SEQ ID NO: 6076 - DNA, 664 bp, Artificial
  Synthetic
cccacgcgtccggtcaatggaggcgagctctttgacaagattgccgtaaaaggaaaactctctgaacatgaaggaaggagacttttccagcagttaatcgatgctgtgagctattgccatgataaaggtgtctaccacagagaccttaagcccgaaaatgttcttgtggatcgaagaggaaatatcaagatctctgactttggcctaagtgctttgcctcaacatcttgggaatgatggattgctgcacacaacatgtggcagccccaattatattgctcctgaggttttgcagaaccgaggttacgatggctcattgtcagatatctggtcttgtggagtaattctctatgtaatgctcgtcggataccttccctttgatgaccgaaatcttgttgtcctgtaccagaagattttcaagggggacactcaaatcccaaagtggctttcacctagtgcacgggatcttcttcgaaggattcttgaaccgaacccgatgaagagaatcaacatagcagggatcaaagagcatgagtggtttcagaaggattacactcctgttgttccatatgacgacgatgatgacaattatcttgactcagttcttccaatcaaagagcaaattgatgaagcaaagcaggaaaagcctactcatatcaatgctt

SEQ ID NO: 6077 - DNA, 1550 bp, Artificial
  Synthetic
ctcaaacatagcctttcgtattcagcttctcatatactcttcgatctgaatagtttattataatatttgagttctctttaatcttttttaatctttttattttggaaaagtttaagatgagtgtatccaagtcccaggtttggcaaccttgtaaaaagaagaggatttagcttaaggcttaatccagaagtaaaaaaaataaaagaagatttttttatagggaagaaaaaaaagaggatggtctttgtattgatttagggtagggatttaataagattgtaggatctgtaagaaatagaaagtttggagatagatgggttcaagatcaaataatggaagtgggaggactacagtgggaaggtatgagatagggaggacagttggggagggtacttttgcaaaggtcaaatttgcaaggaatgttgagactggtgataatgttgccattaagattcttgataaagagaaggtcatgaagcacaagatgatcggccagattaaacgggaaatatcaacgatgaaacttataagacaccccaatgttatccgaatgtatgaggtcatggccagcaagacgaagatatatattgttttggaatttgttactggtggcgaactgtttgacaaaatttctagtagaggtaggctcaaagaagatgaagcaagaaaatactttcagcaacttataaatgcagttgactactgtcatagtagaggtgtattccacagagatctcaagcctgaaaacttgttgctggatgcgaatggtgttcttaaagtttcggattttggactgagtgcactgcctcagcaagttcgcgaagatggactactacatacaacatgtggaacaccaaattatgtggctcccgaggtgatcaacaataaaggttatgatggagctaaggctgacctgtggtcatgtggtgtaatcctttttgtacttatggctggttatttgccttttgaagagtcaaatctcatggcactatataagaagatacataaagctgaatttacatgtccaccctggttttcctctagtgcgaagaaactaatcaaaagaatcttggatcccaatccacagacgcgcatcacattttccgaggtcattgagaacgagtggttcaagaaagggtatcgtccacctgtttttgaacaggcagatgttagtcttgatgatgtgaatgctatttttagtgaatctgctgactcttcgaatcttgttgtggagagacgggatgaacgtccttctgcaccactgactatgaatgcttttgagcttatttcaacttctcagggtctcaatctcagttctctgtttgaaaagcaaatggggctagtcaaaagggagacaagatttacatcgagatgtcctgcgaatgaaattgtctcaaaaattgaagaagctgctgtacctttgggcttcaatgtgaggaaaaataactacaagattaagcttcatggggagaagagtgggcgcaaaggtcatttatccgttgcaaccgagatttacgaggtggcaccttcactatacatggttgagcttc

SEQ ID NO: 6078 - DNA, 1287 bp, Artificial
  Synthetic
gaaaaataccattgattctctggttttttcctgtaaaccctagctaaaaaataccttaattctctttcgggaatgcagagagatgagaggttatcggttttctgatccccttttgactgccggaaaaatccaaaaaccagtcgccggcggcaggaattgccaccggaaacacgtagaagacgggtgaatcaatcacccattttcccccctttctgtcaaccatttccttttttctttacagaaacagacacccttttcattctttagcctcttttttacaaatttaaccaaaatctttctctgttccaaaaaatggcacctgaggagaaatgcatggctttgtacggaaaatacgagctcggccgccttttaggccatggaacttttgccaaagttttccatgcacgtaacgtgcaaaatggcaaaagtgtggctatgaaagttgtgggcaaagaaaaagtgattaaaattggtatgatggatcaaatcaaacgagaaatctctgttatgaaaatggtaaaacacccaaatatcgttgagcttaacgaagtcatggcgagtaaaacaaagatttacttcgccatggagttcgttagagggggtgaattatttgcaaaaatagccaaaggcaggttaagggaagatgtggctagaggctattttcagcaattaatttcagctattgatttctgtcatagccgtggtgtttatcatagagatttaaagcctgaaaatttgttggtagatgaagaaggaaatcttaaggtaacagattttgggcttagtgcatttactgaccatttaagacaagatgggctattacatacaacatgtggaactcctgcttatgttgctcctgaagtgattattggtaaaaaaggctatgatggtgcaaaagctgatatttggtcatgtggtgtaattctttatgttcttttagctgggtttttaccatttcaagatgaaaatattatggctatgtataaaaaaatttataggggtgatttcaaatgtccaccttggttttcatcagaggctagaagattaatcaccaagatgttggatccgaatccaaattcaagaatcactacttctaagattatggagtcaacttggtttaaaaaatcactgccaaagattttaagaaccaaagaggaggaagaattttctataggagatgatataaattgtgtcgaaaaggctaaagatctcgagacattaaatgcgtttcatatcatttctttatcagaaggtttcgatttatcgccattatttgaagagaagaag

SEQ ID NO: 6079 - DNA, 358 bp, Artificial
  Synthetic
atgaagcttcttaaccattcaacattgtccaaatacacgaggtgattggaaccaagacaaagatctgtatagttatggaatacgtttcaggtggtcagctttcagacagacttggaagacagaaaatgaaagaatcagatgctagaaaacttttccaacaattgattgatgctgttgattattgtcataacagaggagtttatcatagagatcttaagccacaaaacttgttactagattcaaagggtaatctcaaagtttctgactttggattaagtgcagttcctaaatcgggggatatgctctctacagcttgtggctctccatgttatatagcaccagagttgattatgaacaa

SEQ ID NO: 6080 - DNA, 391 bp, Artificial
  Synthetic
aattcggcacgaggtaaatgatgggcggatgaaagaagatgaggcgcggagatatttccaacagcttatacatgctggggactactgtcatagcagaggggtctaccatagagacctcaagcctgaaaatttactattggactcctatggaaacctcaagatctcagattttggattaagtgcttttgtcccaacaagtcagggatgatggactcttgcatacatcgtgtggaacaccaaactacgttgctcctgaggttctcaatgatagaggctatgatggagcaacagctgacatgtggtcatgcggtgttgcactctatgtcctgcttgcaggctacttaccttttgatgattctaaactaatgaatctttataaaaaaatatcatc

SEQ ID NO: 6081 - DNA, 680 bp, Artificial
  Synthetic
aaaaattcagtaagtcaatatactcaagacttgtctgaattctgaagaatctgagattaaaccccttttcccttgattatggagcgttatgagatagtaaaggagttgggttctggtaattttggggtagccaagcttgttagtgacaagaaatccaaagagctctttgctgtcaagtttattgaaagaggccacaagatagatgaacatgtgcaaagagaaattatgaatcacagatcattgaaacatccaaatatagtcagatttaaagaggtcttgctgacacctactcatctagctattgtaatggagtatgcttccggaggagaactctttgccaggatctgtagtgctggaaaatttaatgaagatgaggcaaggttcttctttcaacaactgatatcaggggttagctactgccatttcatgcaaatctgtcatagagatctcaaactggaaaatactttactagacggaagtgctgcaccgcgtgtcaaaatatgtgattttggatactccaagtcaactatctttcattctcaacctaagtccactgtagggacgcctgcttatgtagcaccagaaatcctaacaaagaaagaatatgatgggaagcttgcagatgtttggtcatgtggagtcacattatatgtaatgttagttggagcttatccatttca

SEQ ID NO: 6082 - DNA, 644 bp, Artificial
  Synthetic
ttaatccattctataacaatcacgcctccatcccaaacaaacggagaccgccaattcgtaatccttacggattgtgaggaagttttattgggcacaatggcgacgattccccaagaataaataaaaaaattctcaattgtaacgccaatctcttctccaagatgaccaacaagaacgagaagaaaggctacattttgatgcaaaggtatgagattgggaaattgttaggccaagggacatttgccaaggtgtaccatgcaaaaaatctgaaaactggccaaagtgttgctgtaaagatcattgacaaggagaaggtgatgaaagttggcttaattgatcaaatcaaacgtgaaatctctgtcatgaggctaatcaaacacccaaatgttgtccagctctatgaggttatggctagcaaaactaagatatatttcgccatggaatatgtcagaggtggtgaacttttcaataaggttgctaaaggcaggcttaaagaagatgcagctagaaaatacttccaacaattaatcgctgcagttgatttctgtcatagccgtggcgtctaccaccgtgatctcaagcctgaaaatctcctcctcgacgaagatggaaacttgaaagtgtcagatttcgggctgagtgca

SEQ ID NO: 6083 - DNA, 642 bp, Artificial
  Synthetic
tagatatagtagtactgtgggaatacccatcttctctcataaagtgaacctgaacctgaaggccatagttggaccctgtgctaagtaaggaagcatggatcgttatgaggcagtgagagatatcggggttggtaattttggtgttgctagattggtaagaaataagaagacaaaggagcttcttgctgtcaagtacatcgagcgaggccccaagattgatgaaaatgtccagcgtgagatcatcaaccatcgcttgctccgccatcccaacattattcgcttcaaagaggtttgcttgactgccactcatttggccatcgttatggaatatgcagcgggtggtgagctttttgaacgcatttgtgatgctgggaggttcaatgaagatgaggctaggtttttcttccagcagttgatatcaggggttagctattgccatgatatgcaaatatgtcatcgggatttgaaacttgagaatactctactggatgggagtcctgctcctcggctgaagatatgcgactttggctactcaaagtcggcactcttgcattctatgccaaagtccacggttggaacaccggcctatattgccccagaagttctttctagaaaagaatacgatggcaagcttgcagatgt

SEQ ID NO: 6084 - DNA, 564 bp, Artificial
  Synthetic
tggtatcaacgcagagggcattacggccggggagcttatagctccttttacttgttattctatcacaaatcaaatcacaaaataccctgttcggttgcaaggcatcgatcactctagatcgatgcctgaaatcgaacaattttccgaggccacggccccttcagagagttgcctatttggtaaatatgagctcggaaagttacttgggtgtggtgcatttgccaaagtgtaccacgctagagacatcagaaatggccaaagcgttgcagtcaaagttatcaacaagaagagaattgccaatccgactttgattacaaacgtcaaacgtgaaatctatattatgcgtcgattaagtcacccccatatagtcaaactgttcgaagttcttgcgacaaaaacaaagatctatttcatcatggagtttgtcaaaggaggtgaattattcagcaaaatttccaagctgggtcggttcaacgaagatctgagccgcaaatatttccagcaactcatatcagccgtacgatattgtcattctcgtggggtgtaccatcgtgatttgaaacc

SEQ ID NO: 6085 - DNA, 652 bp, Artificial
  Synthetic
  misc_feature (570)..(570): The residue at this position can be any nucleotide.
gtgaattgttcgcgaaggttgccaaaggaaggttaagagaagatatagcacgtggctattttcagcaattgatttcagctattgatttttgtcatagccgcggagtttatcatagggatttaaagcctgagaatttgttgttagatgaagaaggtaatcttaaggttacagattttgggcttagcgcgttttcggatcatttaaggcaagatggtttgttgcatacaacttgtggtacccctgcttatgttgcacctgaagtaattggtaaaaatggctataatggtgcaacagctgatatttggtcatgtggtgtaattctttatgtacttatagctggttttttaccatttcaagacgagaatattatggctatgtataagaaaattcataggggtgattttaaatgtccaccttggttttcatcagatgcaagaaagttgataacaagaatgttggatccgaatccgagtactcgaatcactgcttcaaaaattatggattcctcttggtttaagaaatctatgccaaagacattgaagactaaggaggaggaagaatttggcgtangaaaggcgaaaatgattgagtctttaaatgcttttcatatcatatctttatcggaggggttcgatttatcacctttgtttga

SEQ ID NO: 6086 - DNA, 585 bp, Artificial
  Synthetic
aaagaaaaaagccaaaatcttgttcgtcaagcccaatatgctttcctgaaaaaccagaaaaggaaaaataatgggttgaagaaatttggaagaagaagaagaagaagaagaaaaacggtgtcgtgtttggtaggaaagatggtgataaggaaattaggcaagtatgaagtagggaggacaataggggaaggaacatttgccaaagttaaatttgcacagaatacggaaactggtgaaagtgttgcaatgaaagtcctcgatcgtagtactatcatcaaacacaagatggttgaccagataaagcgggagatatcgataatgaagcttgttagacatccatatgtagttcgattacacgaggttatagcaacccgcactaagatctatattatcttggaatttattacaggcggtgaactgtttgataaaatagttcaccttgggcgattaagtgaagccgagtcccgtagatactttcagcaattgattgatggagtggattattgtcacatcaaaggagtctatcatagagatttgaagcctgaaaatcttctgctagattcccaaggagatctgaaaatatca

SEQ ID NO: 6087 - DNA, 574 bp, Artificial
  Synthetic
cccacgcgtccggaaagaccgtacctctatagatgactttgagataataaaaccaattagtcgtggtgcatttggccgtgttttcttggcaaaaaagagagcaactggagatttctttgcaattaaggttttgaagaaggcagatatgatacgcaaaaatgccgttgagagtatcttggcggaacgaaatattttaatatcggttcgcaatccctttgtggttcgcttcttctactcttttacttgccgtgaaaacttgtaccttgtgatggaatacctgaatgggggggacctgtactcattgttgaggaatcttggttgcttggatgaagacgttgctcgtgtatatgtcgctgaagtagtgcttgctctggaatatctgcactctttgcgagtggttcatcgtgatttaaagccagacaatttgttgattgctcatgatggtcatatcaagttgacggactttgggctttctaaagttggtcttatcaatagcacggatgacttgtctggtccggcagtcagtggagcatccatgatggaagatgatgaatctcagttattggcacctgag

SEQ ID NO: 6088 - DNA, 645 bp, Artificial
  Synthetic
gaggagaagcgaacaatgtcgggagcagaagaagacaagaagcccgccggcgatcaggctggtcacatcaatctcaaagtcaaaggccaggatggcaatgaagtattctttaggatcaaaagaagcacccagctgaagaagctgatgaatgcttattgcgaccgacagtcggtggatttcaattcaattgctttcttgtttgatggccgtcgtcttagagcagaacagacaccagatgagctggagatggaagatggtgatgaaattgatgcgatgttgcatcaaactggaggcacaattctttgagtcttctcttccgtttgtggacctagactttatgcgtgtttcaaggtggtatggactcggtgaaaatgtaggttgttcaactttagggcctgtagtgtgtaatgaatgtcatcatgtttgcttcatgttgactagctcggctgaacttcatcgctactgtaacttgatatgaaagtcattacttccttaaccgtttagttttctaaagatgacatgaattcaaagtcttggtttgtttcaaataaccccctcccccaaccttcatgaaataagaagcttggcaacacgaagtagctccagtgtaccctgctgggcacctcgtatatcacagtttggttc

SEQ ID NO: 6089 - DNA, 612 bp, Artificial
  Synthetic
tgcaaacagaggaagataagaagccgagtggagatcaaggtgcacatatcaatctcaaagtcaaaggccaggatgggaatgaagtcttctttaggatcaaaagaagcacccagctaaagaagctgatgaatgcatattgtgaccggcagtcggtggatttcaactcaattgcattcttgtttgatggtcgtcgtctccgagcagagcagactccagatgagctggagatggaggatggtgatgaaattgatgcaatgttgcatcaaactggaggctcaactgtttgagtgatctcttttgcttatggacagactgtatttctaggtggtagaccttaatgaatgtagcttgtgctactttaggacctgtaggagcatagatgagctttgtgatttttgcttatgtcggaccagctttgtataaacataatttttactcactgttgcaagaagaacattagttgcttcttgccgtgaaattaaagtactacttgttcatatatatatgtattcaaagaagtttaaccaagcaggagggaatgctctcggcgcacgttaacgcaataaaacagtaaaaattggcgtaagttagcacgaagctttctcgctgata

SEQ ID NO: 6090 - DNA, 639 bp, Artificial
  Synthetic
ttcttcgtcttcctcgttgcgaattacagagagagagagagaggaagagagagagaagaattccggcagctatggcggaggccacgaacaactatgccggagctccgaaggctgaggaggaaaagaagcctctcgaccagcacctcaacctcaaggtcaagggtcaggatggcaacgaggtctttttccggattaagcattcaactcagctacggaagttgatgcatgcttattgtgagaggcaatctatcgacttcaatgcaatcgcttttctatttgatggccgccgcttgcgagcagagcagactccggcagagttggaaatggaagatggtgatgaaatcgatgcgatgcttcatcagactggtggggcctgctgataataatctccaccttgccagtgattctctcttatgtatttttaactcgtataactgctgctcctttttgaaatcttaatcaacgtggtgtacttgtaccaaggatttctttgtttacttggggggcacaccaggtctgaagaaaaacactgcatttttcttctctacagtcatgatatatatttgtgcccaagagttgaactaaagttaggaaatccaaagatgtacctatgatttaacttgtgcacgtaaaagattc

SEQ ID NO: 6091 - DNA, 646 bp, Artificial
  Synthetic
gaaagagaaagagaagaaatcgatggcagatgggacgaacatgacgggagtcaccaacgcagctgatgacaagaagcccctcgaccagcacctcaacctcaaagtcaaaggacaggatgggaatgaggttttcttccggatcaaacgcagtacacagttgaaaaaacttatgaatgcctattgtgaaaggcagtcgattgacctcaactcgattgctttcctctttgatggtcgtcgcttacgtggggagcagactcctgatgagctggagatggaggatggtgacgaaatagatgctatgctgcatcagacaggtggttgtgtaagacaactaaattactaaggtgcttaaacagtgactcgctcatccgaatcctgttctaattgtttgcgtttgactttattgggtttctaaagaattggaaatccagggactcgacatagtagccgctagaactctaatcttattatgatggaaccaaaatgcttgttatctaaaattcctggtaagattgaagtgaaaaaggatctgccccctatgaaatgttttgtttgcctatatattggatcgtaggtgctccttttgtggatgaagttgacatcgtaaatatacactttgtactcggttttatggcagttgtttatg

SEQ ID NO: 6092 - DNA, 625 bp, Artificial
  Synthetic
taacgttccaacaacccagaacacatctatgaaacaattctctttactgcaattccactaaaattttcagctcattcccaacacagcgctgtaaaaatggtatcttccaccattctaattcaacaaccaacaagcttgttccaccagccagagtttcaccatcagttatggaggcatgggtgtgctgcaccattgcaaaagcaacccattattgtttgtggtagtaacaagggaagaagcagacccttgagagttagtgcaagtgctaatggtgctgcaacttcttccactctagagggttatgattcttctccatctccttctgcatttcctctttttacacccccttctcaatcccaagatactcccgcttctcagctggaactggcagatcctgatttctataaaataggatatgttagaagttttcgagcctacggaattgaattcagggagggaccggacgggtatggagtgtttgcttccaaggacgtggagcctctccgtcgagctagggtaataatggaaattcctctagaactgatgttaaccataagcaaaaagcttccttggatgttttttccagatatcatacctgtgggacatccaatattcgacattatca

SEQ ID NO: 6093 - DNA, 678 bp, Artificial
  Synthetic
aacattttattgattcttatcatccaaacatggccttctcctcctccactgctcaaacagcttcacctctatcctccaaacattgttcccgcctatcttcctccgccgcctcctcctcctcttacttccctaaatttcaaatacccttcaaattcaacgaaattacatcttgcccttcctcaatttcctgtgtccttaccaaacaggaatcaatggcggctcgagaggctgctgaaccggcggttcccctgcgtcctgattcgtttggccggtttggtaaatttggcgggaaatacgtacctgaaaccctaatgcacgctcttgacgagctcgagaccgccttcaaattgctcgctaccgatgaagcttttcagaaagagctagatggaatattgagagattatgtaggcagagagagccctctttattttgcagagagacttactgagcactacaaacgtccagatggccaagggccattgatctacctgaagagggaggatcttaaccacactggtgcccacaaaatcaataatgcggttgcccaagctttgcttgccaagcgcttgggcaagaagcgcatcattgctgagacaggggcaggtcagcatggtgttgctactgctactgtttgtgctcgctttggtttggaatgtattatctacatgggtgctcaag

SEQ ID NO: 6094 - DNA, 569 bp, Artificial
  Synthetic
gaattcacttgtaaatggctttctcatcctccactgttacttgcaaaaaccctaattccaatctccttcaaaaaccatacttttcttcgtcttcttcctttaatcctttacgagttcatttccagaaatttcctttaccttcttcttcttccattaaaagttcttcaatttcttgtgcagtaaccgaagagaaacccaaaatgtcgactgtttcgcagagacctgattcttttggtaggtttgggaaatttgggggaaaatatgttcctgaaacactaatgtatgcacttacggagcttgaatctgcgtttcggtcattggcggcagaccaagattttcaggaagaattgagtggaattttgaaggactatgttggtagggagacacctctttactttgcagagaggttaacggaacactataagtctgctaatggtgaaggacctcatatatatcttaaaagggaagatcttaaccacacaggtgcccacaaaatcaacaatgctgttgcccaagctttacttgcgaagcgattggggaaaaaacggattatagctgagactggagct

SEQ ID NO: 6095 - DNA, 642 bp, Artificial
  Synthetic
tccactgctcaaacaacttcacctctatcctccaaacattgttgccgcctatcttcctccgcctcctcctccgcttcgtacttccctaaattccaaatacccttcaaattcaacaaaattacatctggcccttcctctatttcctgtgtccttaccaaacagaaatcaatggcagctcaagaggctgctgaaccggtggttcccctgcgtcctgattcgtttggccggtttggtaaatttggcgggaaatacgtacctgaaaccctaatgcacgctcttgacgagctcgagaccgccttcaaattgctcgctacagacgaagcttttcagaaagagttagatggaatactgaaagattatgtaggcagagagagccctctttattttgcagagcgccttactgagcactacaaacgtccagacggcgaaggtcctctgatctacctgaaaagggaagatcttaatcacactggagcccacaaaatcaataatgccgtcgcccaagctttgcttgccaagcgcttgggcaagaaacgcatcattgctgagacaggggcaggtcagcatggtgttgctactgctactgtttgtgctcgctttggtttggaatgtattatctacatgggtgctcaagatatggag

SEQ ID NO: 6096 - DNA, 658 bp, Artificial
  Synthetic
ggcacggcggcggcgtcacggcgattcattgcttctcctccttccgatcagctcggcacggaggtggagttgccggcgaggatcaatctgccgcggcgcagcgttcgggcagcgatctcgtcccagggcgccgtggcgccggcggaggcggaggacgtgttgcatgccgagtatggagggttccagcggccggatgcgtttggaaggtttgggaaattcggtggtaagtatgttccggagacgctcatggcggcgctggcggatctggaggccgcgtatcgattgcttgttggcaagcccgaatttcagcaagaattggctggtattctcaaagactacgttggacgagagtctccactctactttgccgagcgcttgacgcagtactacaagaacgccaatggcagtggacctgatatatatctcaagcgagaagatctaaaccacaccggtgctcacaagatcaacaatgccgtcggccaagccttgctcgccaagcacattggcaagaagcgcatcatcgccgaaactggagccggccagcacggagttgccacggccactgtctgtgctcgctttggactggaatgcgtcgtttacatgggtgcacaagacatggaaaggcaagctctcaacgtgtatcgtatgcggcttctcg

SEQ ID NO: 6097 - DNA, 772 bp, Artificial
  Synthetic
atcactatggcaggaggtagggtttccgggattctcgtccttctcgcggtatggggcttgattgctgtggctgcgccggcgatggcgcgggtcgcggtgccgctcaagaagaagccgctgtcgacagagcgcttgaggcttgcggtgagagatattcctcgtagggcgcaggcgctaggctacccggatgtccgggacgcgaattctcgcgctggaaatggcagcgttccggattacgagcccctcaagaactacctcgacgcgcagtactatggcgagattgggattggaacccctccgcagctcttcacggtcatcttcgataccgggagctccaatctatgggttccctcgtcacgatgcattttctcgcctgcttgctggttccaccaccgctacaagtccaagaggtctaccacatacgagccggatggtacttctatcgctatcaagtatggaacaggccagatggctggatttttgagcaccgattccgttactattggcgacattgtggtcaaagatcagacgtttgctgaagcgacaagggagccaggacttgttttcgttattggcaagtttgatggcattctcgggctcggattcaaggccatctcccagggacaagttactcccgtctggtataatatgttgtcccagaaattgatatcagaaccagtgttttccttctggcttaaccgagatgcttcggacgacgaggatggtggtgaaatcgtcttcggaggagtgaacaagaagcgttttaagggag

SEQ ID NO: 6098 - DNA, 975 bp, Artificial
  Synthetic
gttttcttgcttcatcaaactggtcaatatgggagcaaaagcttttcttgtcaccattttactctcatcgctgttatttcctttggccttgtctacatcaaatgatggcttggttagaattggactgaaaaagataaaatttgatcaaaacaatcgacttgctgcgcgagtcgagtccaaggagggggaggctttgagggcctccattaggacgtataataacttccgtggtaatcttggggcctctaaggatacagacattgtagcactgaagaactatatggatgctcagtactttggggagattggtataggcactccccctcagaagttcactgtcatctttgatactggtagctctaatttgtgggtgccttcatcaaagtgctacttctcagttccctgttttttccattccaagtataagtcgagccaatcaagcacttataagaaaaatgggaagtctgctgccatacgttatggtactggagcaatatctggatttttcagtcaagatagcgttaaagttggtgatctggttgtgaaaaatcaggagttcattgaggcaaccagagaacccagtgtgacttttttggtagccaagtttgatggtatattgggtcttggtttccaggagatttctgttggaaatgctgttccagtatggtacaacatggtcaaacagggtcttgtcaaggagcctgtcttctcattttggctcaaccgaaatacagaggaagatgaagggggcgaaattgtgtttggtggggttgatcctaaccactataagggaaagcacacttttgtcccagtcacacggaaaggttattggcagtttgacatgggtgatgttctgattgatggtcaagctactggttactgtgacaatggatgttctgcaatagcggattctgggacttctctcttggctggtccaacgactgtaatcactatgattaatcatgccattggtgc

SEQ ID NO: 6099 - DNA, 333 bp, Artificial
  Synthetic
cccacgcgtccgcctctgggtgccatcatcaaaatgctatttctcacttgcatgtctcttgcatcccaaatacaagtcgtctcgttcaagcacatatgagaagaatggaaaagctgccgcaattcattacggcactggagcaattgctggtttttttagtaatgatgctgtcacagttggcgatttagttgtcaaggatcaggagtttatcgaggcaaccaaggagcctggtataacatttgttgtagctaaatttgatggtatccttggtcttggattccaagagatctctgttggaaaagctgctcctgtttggtacaacatgctcaagca

SEQ ID NO: 6100 - DNA, 687 bp, Artificial
  Synthetic
tttttctcccgtatcgatcctctgtgctaagcatgggtactacatatggaacctgtttaattgcattgtgtttgttgcttcttttatcccctatggcgttttctgtatcaaatgatggactgatcagagttggaattaagaagaggaagttggatcagatcagccaggcttttgggggtattgattctaatggagcaaattctgcaagaacttatcatcttggcggaaatataggagatgcagatactgatattgttgcactaaagaactacttggatgctcagtattttggtgagatttgcgttggatcaccacctcaaaagttcactgtgatctttgataccggaagttctaatctttgggtgccctctgcaagatgttatttttcacttgcttgttatttgcaccccaagtacaagtcaagtcattccagtacctacaaaaggaatggcacatctgctgcaattcgctatggaactggatctatttctggatactttagcaatgacaatgtgagagttggtgatcttattgtcaaagatcaggactttattgaggcaactcgagaaccaggcatcacctttttggcagccaagtttgatggtattcttggtcttggatttcaagagatatctgtggggaaagccgtccccgtctggtacaatatggtaaatcaaggtcttgtta

SEQ ID NO: 6101 - DNA, 540 bp, Artificial
  Synthetic
ggtggttctgtgttcgaatctgggtctcctgtccagccctccctagccccccagagtgtagccatggctgcccaagccctttccctgtgtgttgtcgcccttctcctgctggtttcctccgtctcttccttgccttccccgcagctccgtcgcgtcggcctcaagaagaagcctgtcgatgaggacaccctccgtgccgccaagatgcggctccgctccaagtacgcccaccgagacagcgccctcctccgtagccctctcctcaaggagcaggatgtcgagctcgtcaactaccttgacgcccagtactatggcgagatcggcattggaacccccccgcagaacttcacggtcatctttgacactgggagctcccaacctctgggtcccctccgccaagtgctacttctcgctgtcatgttatttccatccgaaattcaaggggagcaagtcagagacatacaaagtgaatggacaagaatgtgacattcaatacggaagtggggctgtggctgggtttctttccgaggatactgtgac

SEQ ID NO: 6102 - DNA, 1135 bp, Artificial
  Synthetic
cgagcgtgggggcaaatagcagtatccatccattctcctgagtactactcttctccatacctgttaattactgctttctactctctaaaagtttctcctacatttctggggtttcatcattaagacactccgcgaatatggaaaggaaacatctctgggctgctctccttttatggaccattgcgtgctttgtacttcctgtttactctgataatttgcttagagttggtttgaagaagcaacccctggacattaatagcataaatgctgcaagagtagccagacaacaggacagatatgggaagaatgtgaatggaatagaaaagaaattgggtgactcagatttggatatagtctccttaaagaactacttggatgcccaatactatggagagattggtgttggttcacctcctcagagattcaaagttatctttgatacaggaagttctaacctctgggttccatcatcaagatgctatttctctattgcatgctggatccactccaagtacaaggcgggcaagtccagtacatatacaagaaatggggaatcttgttcaatccgttatggaactggatcaatctctggccatttcagtcaagacaatgttcaagttggtgatctcgtagttaaagatcaggtgtttattgaggcgacgagagaaccaagtattacatttataattgcaaagtttgatggtatactagggcttggtttccaggaaatttctgttggaaatgctacacctgtctggtacaatatggtggggcaaggtcttgtgaaagagccggtcttctctttctggattaaccgtgatgcaactgcaaacgaggggggtgaacttgtttttggtggagttgattcaaatcacttcaagggtaatcatacttatgttcctttgactcagaagggctactggcagtttaatatgggagatttccttatcgggaacgcatcaacaggtgtttgtgcaggtggttgtgctgctattgtggactctggaacatctcttcttgctggtccaacaactgtcgtgactcaaatcaaccatgccattggagcagaaggagtagttagcatggaatgtaaaactattgtttcccagtatggagagatgatctggaatttact

SEQ ID NO: 6103 - DNA, 629 bp, Artificial
  Synthetic
gctgttgctgctgctgctcctcccgttttccgatcgcagccatgggaacccgcagcgtggccttggtgctcctcgcggccgtgctgctccaagccctcctccccgcttcggcggcggagggtttggtgcggatcgcgctgaagaagcgcccgatcgacgagaacagccgcgtcgccgcgcgactctccggcgaggaaggggcgcgccggctgggcctccgcggcgccaactcccttggcggcggcgggggtgagggcgacatcgtggcgctgaagaactacatgaacgcgcagtacttcggggagattggcgtcggcactccgccgcagaaattcaccgtcatcttcgacactggcagctccaacctctgggtgccgtcggccaagtgctacttctcgattgcgtgcttcctccactctcgctacaagtccggacagtcgagcacttatcagaagaatggaaaaccagctgccattcagtatggcactggttcaattgctgggtttttcagcgaggatagtgttacagtaggtgatctggttgtgaaagatcaggaattcattgaagctaccaaggagccaggtcttactttcatggttgcaaaatttgatggcattcttgggcttgga

SEQ ID NO: 6104 - DNA, 175 bp, Artificial
  Synthetic
cccacgcgtccgcccacgcgtccgcccacgcgtccgctccggcgcgcacttcaaccccgcggtgacgctggcgttcgcgacgtgccggaggttcccttggcggcaggtgccggcgtacgcggcggcgcagatgctgggcgccaccctcgccgccggcacgctccggctcatgttc

SEQ ID NO: 6105 - DNA, 349 bp, Artificial
  Synthetic
cccacgcgtccgcgcggagtttcttggaacctactttttggtattcaccggttgtgcatcggtggttgtaaacatgcaaaacgacaatgtcgtgactcttccagggatcgctatcgtttggggactcaccatcatggtcctcatttactctcttggtcacatctctggtgctcatatcaatcctgccgttaccattgccttcgcctcttgcggccgtttccctctcaaacaggttccagcttatgtcatatcacaagtgatcggatcaacgctcgcggctgcgacattacggttgttgttcggacttgatcacgacgtttgtagcgggaaacatgatgtgtttatcgga

SEQ ID NO: 6106 - DNA, 625 bp, Artificial
  Synthetic
gttcattaattctttgtcctataatattatagttttatcttaatttgagctataggtatggatcctgaagatggaatatcagccccttcaacaccagcaactccaggaactcctggtgctcctctttttggtggtttcaaacatgaaagaaacaacaatggcagaaactctctcctgaagagcttaaaatgcttcagtgtggaagcatgggcttcagaagaaggaagcttgccgcctgtttcatgcgcgttacctcctcctcctgtctcactagccagaaaggtaggagcagagttcataggtactatgatactaatttttgcagggacagcgacagcaattgtgaaccaaaagacacagggatctgaaaccttaattggattggcagcatccagtggtcttgctgtaatgattgtgattctgtcaactggccacatttctggagctcatctcaacccagctgtgaccattgcttttgctgttctcaagcatttcccatggaaaaatgttcctgtgtacattggagcacaaattatagcatcattttgtgctgtattcacactcaaggtagttttgcacccaataatgggtggtggagtcactgttccttctggtagttaccttc

SEQ ID NO: 6107 - DNA, 683 bp, Artificial
  Synthetic
cccacgcgtccgcggagccagcgagctagccagccagtgttagagcttgagctgcttgttcttcttctacctcctgcactcgcgtgctgcacaagtagctcagctagatagagcgtcagaaatggccagcaacaactcgagaacaaactccagggcgaactactccaacgagatccacgatctctccacggtgcagaacggcaccatgcctaccatgtactacggcgagaaggccatcgccgacttcttccctcctcacctcctcaagaaggtcgtgtcggaggtggtggccacgttcctgctggtgttcatgacgtgtggggcggcagggatcagcggcagcgacctgtctcgcatatcgcagctgggacagtcgatcgccggtggcctcatcgtgacggtgatgatctacgccgtcggccacatctccggcgcccacatgaaccccgccgtgacgctcgcgttcgccgtgttcaggcatttcccctggattcaggttccgttctactgggcggcgcagttcaccggagcgatatgcgcgtcgttcgtgctcaaggcggtgatccacccggtggatgtgatcggaaccaccacgcccgtggggccgcactggcactcgctcgtcgtcgaggtcatcgtgacgttcaacatgatgttcgtcacgctcgccgtcgccacggaca

SEQ ID NO: 6108 - DNA, 526 bp, Artificial
  Synthetic
  misc_feature (291)..(291): The residue at this position can be any nucleotide.
gtcgaccacgcgtccgccttcttcttcttctttctctactcacctggatctgtagagagagagagagagagagagagagagagagatggcaggaggtgacaacaactcccagaccgcaatggcggctcaggtcacgagcagagagccatggaggaaggcaggaagcaggaggagttcgccgccgacggccagggctgcggcctcgccttctccgtccccttcatccagaagatcatcgcggagatctttgggacatacttcttgatcttcgcggggtgcggggcggtgacnatcaaccagagcaagaacgggcagatcacgttcccgggggtggcgatcgtgtgggggctggcggtgatggtgatggtgtacgccgtggggcacatctccggcgcgcacttcaaccccgcggtgacgctggcgttcgcgacgtgccggaggttcccttggcggcaggtgccggcgtacgcggcggcgcatatgctgggcgccaccctcgccgccggcacgctccgggtcatgttcg

SEQ ID NO: 6109 - DNA, 590 bp, Artificial
  Synthetic
gagcgagcgagctagccagccagtgttagaacttgagctgcttgttcttcttctacctcctgcactcgcgtgctgcacaagtagctcagctagatagagcgtcagaaatggccagcaacaactcgagaacaaactccagggcgaactactccaacgagatccacgatctctccacggtgcagaacggcaccatgcctaccatgtactacggcgagaaggccatcgccgacttcttccctcctcacctcctcaagaaggtcgtgtcggaggtggtggccacgttcctgctggtgttcatgacgtgtggggcggcagggatcagcggcagcgacctgtctcgcatatcgcagctgggacagtcgatcgccggtggcctcatcgtgacggtgatgatctacgccgtcggccacatctccggcgcccacatgaaccccgccgtgacgctcgcgttcgccgtgttcaggcatttcccctggattcaggttccgttctactgggcggcgcagttcaccggagcgatatgcgcgtcgttcgtgctcaaggcggtgatccacccggtggatgtgatcggaaccaccacgcccgtgggg

SEQ ID NO: 6110 - DNA, 593 bp, Artificial
  Synthetic
aatccatggcaggagcagcagcagcagcagcagcagcagcaggaggatcggcagggatgaatgacttccagctcaacgagatccgcgtcacccctgttgcttctatcgctctcccttcgaacggccagctccaccaccagagcgtgaatacagtcgacgactactccgccggatgcttcccagcctcgattgttcccaaatcgactctcttccagaagattggtgccgaggtgattagtactttcattgtcgtcttcgcgggatgtggcgcggctatggtggatgccaagtacaaggattcggtcactcatctcggtgtgtcggcggcgtttggcttgttgtgatgatcatgatctacgctgtcgggcatatctctggagctcacatgaatcctgccgtcacactggcctttgcggccgtgcggcatttcccgtggaagcaagtccctgcctacatcggcgcacagatcactgcagcgatcactgcggcatttgcgctgcggctgatcatcagccccgtggccaacatcggtgccaccattcccgctggaagtgatcttcaatccttcttcttggaagtgatcatcacctaca

SEQ ID NO: 6111 - DNA, 597 bp, Artificial
  Synthetic
ggggtagagagtcattcacctggctctccttcctcgctcaaaagcctctgccttccccgcacgagatttcgcaagagggctaccctgtgccagaagcttggtgcagaagtcattgctaccttcatcctggtatttgcaggagctggtgcgggaatggtgaaccagatcacgcaaggctcactgacgtttttcggcgtggccgcggcaaatggtctcgtcgttatgatgatgatctatgccactggtcacatctccggagctcacatgaatcctgcagttactctggcttttgcaactgttcgacactttccttggtctcaggtgccgctttatataggctcccagatcaccgcgtccgtgagcgcttgctttgtgctcagacagctcctcacagaagtgaataagatcggagcgacagtccctgctgccggaaatgtggtccaggccctggttctggagatcatcgtcagctacatactcatgtttgtggtggccgcggtttccactgacactcgagccgtgggagagctggcggggctagctgttggagctacagtcgcgctcaacaatctcattgcggggtactgtttctcttat

SEQ ID NO: 6112 - DNA, 692 bp, Artificial
  Synthetic
ccaaatattcctcggacacggtcacttttttttcatctcggtttcttgctcactttttattcatcttaatcttcaatattagctacaatgtatcaagcagcagagtcatcttgggctggaaattaccacaacaacataacaacaaggcgtggatcgttatcgtcgtcagacccgttggagagggttgtgaggctggcgtcaggaagcgcggtggtgatattcagcgtgagcacatgttgcatgtgtcatgcagtgaaaaggctgttttgtggaatgggagtgcaccctacggtgtacgaattggaccaagaccccaaaggcaaagaaatggagagagcactctctaggcttttaggcaatgctcctgctgtccctgttgtcttcattggtggaaaactaattggggcaatggatagagttatggcttctcatattaatggcactcttgtcccacttctcaaggaagccggcgctctctggctttgatttgaccaaaaaaatagcaggataaggttgatggatggattattcctccattttttatttttggtttccttaattaatgtgctttaagttttgtagctaagtatgttatagttgatataatgcgtcaatttaactagtaactgtttaatttcatggcaaccttgtagttgatgcgctgatgcatgtatttgatgattaactatctc

SEQ ID NO: 6113 - DNA, 391 bp, Artificial
  Synthetic
attgtcctgagccctcataccaaaatctgaccatggacaaggttatgagaatgtcatcggagaaaggagtcgtgatcttcaccaaaagttcatgttgtctctgctacgccgtgcaaatccttttccgtgatcttagggttcaaccaacaatccacgagatcgacaacgatcctgactgccgtgagatcgagaaggccttagttcgtcttggctgcgccaacgcggttcctgctgtctttgtaagtggcaagctcgtgggttcgaccaacgatgtcatgtcgcttcacctaagtggctccctcgttcccttgatcaagccgtatcagtcatttcataactagaaaaacaatatcgatgcttaagaaagataattagtatatactattaattg

SEQ ID NO: 6114 - DNA, 710 bp, Artificial
  Synthetic
  misc_feature (152)..(153): The residues at these positions can be any nucleotide.
  misc_feature (606)..(606): The residue at this position can be any nucleotide.
atggaaggttggaaggtctctaattcataatgcagtcaccgcagctgatgggaccattaagttgttaataaaactcgaggacaaccgattggtcgagactgttggaattccagttaaagacaaagatggttcatctcgcttgacttaggtgnnttatctcaggtgggctgcccattacgctgttcgttctgtgccactggcaaaggaggattctcaaggaaccttaagagccatgaaattgttgatcaggtcttggcaatagaagagctattcaatcagagagtgacaaacgttgtctttatgggtatgggggagccaatgttgaacatgaaagaagtccttgaagcacatcgttgcctgaataaggatattttgattgggcaaaggatgattacgatttctactgttggagttccaaacaccataaagaagctcgcatcttacaaacttcagtcaacattggctctcagcttacatgctccaaatcagaatcttcgggaaaagattgtaccaagtgcaaagtcctaccctttgaatgcaattatgaaggattgcagggactacttcctggaaactagaagacgggtttcctttgaatatacactnttagccggagtgaatgattcggtcgagcatgcgattgaactggcagaattgcttcatgaatggggtcgtggtcatcatgtgaacttaataccatataatccaat

SEQ ID NO: 6115 - DNA, 527 bp, Artificial
  Synthetic
ccccccgaaccatcacctctttcacaccatatcctataatggggaactcaccgacgccgacaatgctggcgttcctggctcttgggctagcgctcctcctctccggcaccggccaggcgagcgcgcagaactggggctgccagtcgaacatgtgctggagcaaatgggggtactggggcacgggcaagggctactggggaaatgggtgccgctctggcccgggctacggcggcggcggcggtggaggaggaggaggcggaggtggtggaggcggaagcggaggcaacggcgtgtctggaaagagcgtggtcaccgaggcgttcttcaatgggatcaagaaccaggccccgaacggttgcgccggcaagaacttttacacacgacagtcgttgcttaacgctgcccactcctactcgggcttcgccagggaccggaccaacgatgactccaagcgtgagatcgctgccttctttgcccacgtcactcatgagaccggacatatgtgctacatcaacgagataaacggg

SEQ ID NO: 6116 - DNA, 619 bp, Artificial
  Synthetic
ggcccgcgagggggttctacacctacgcgtcttcgtcagggccgcgacgaggttcccccggttcgccgccacgggctgcgccgacgcccgcaagcgcgaggtcgccgccttcctcgcgcagatctcccacgagaccaccggcggctgggccaccgcgcccgacggcccctacgcctggggcctctgctacaaagaggagatcaacccgcagagcagctactgcgacgccaccgacaagcagtggccgtgctaccccggcaagtcctaccatggccgaggccccatccaaatctcatggaacttcaactacgggccggcgggccaggccctgggcttcgatggtctgcgcaacccggagatcgtggccaactgctcggacatagcgttccagacggcgctgtggttctggatgacgccgagggacaccaagccgtcgtgccaccaggtgatggtcggggagtaccggcccggcccggccgacgtggcggctaaccgcacggcgggcttcgggctggtcaccaacatcgtcaacggcgggctcgagtgcaaccgggcaggcgacgcccgggtgaacaaccgcatcggcttctaccggcgctactgccaggtgctcggcgtc

SEQ ID NO: 6117 - DNA, 533 bp, Artificial
  Synthetic
atattgcaaagctctcaatcctttcacttgtgctgctccctcttgttctaactctggtcgcagcaacccactgtaactgcggagaaagaggacgacaaggcggccacgacactactctgccagcaccgtctatcagcgccaacattggaaccatagtgacgaattccctgtttgatcattttgctcgacaagaccaagctcggactcggctgtgccggtggatccttctacactcacgattccttcatggctgccgcaaaggcgtacccgaagtatggctgcaccgggtccgaggagcagcgcaagacggagatcgcttccttctttgcgcagacgtctgcgcagaccgctggaggtggattgcaactccactggatattgtttggttgaataaccagaaaggaaccactactgtaagccatcagctgcttggtcttgtgccccaggaaagagctaccatggtcgaggacctctgcagctcaaatggaactataactatggaccttgtggacatgcacttggctttgatggcg

SEQ ID NO: 6118 - DNA, 334 bp, Artificial
  Synthetic
cccacgcgtccgccatattcctcaacaacatcaaaatgttgactcccaccatttctaaatccatctctttagtaaccattctattagttctacaagctttctctaacacaacaaaggctcaaaattgcggttgttcgtcagagctatgttgtagtcagtttggcttttgcggtaacacttcagactattgtggtgtaggttgccaacaaggaccttgttttgctcctccccctgcaaatggtgtctctgtggctgagattgtaacgcaagaattcttcaatggaatcatcagtcaagccgcgtctagttgcgccggcaatagattttacagtcg

SEQ ID NO: 6119 - DNA, 764 bp, Artificial
  Synthetic
atcttcaactccgagttctcttcctcctgctcgcgatcttagctgccgctgccgaagactgcggacgacaaggcggcggaagaagttgtccgcctggaaactgctgcagcaggtggggatggtgcggtgacactcccgaccactgcggcgaaggctgccagagtcagtgcggtggagtaacaccgccgcctggtgacggtgtcggatctatcatcacgaactccatcttcgagagcctgctcaagcaccgcagagactcgggatgtgccggtggcttctacacgtacagtgcgttcctcacggctgccagatctttcccgcggtttggaaacgaaggctcgttggagcagaggaagcgagagctcgctgccttcctggcacagacatccaaggagaccacaggtggatggccgactgctcctgacgggccttatcgatggggctattgcttcgttgaggaacaaaataaggacatctactgcagcgcttcggcgacatggccatgtaatggcagcaaaagatactttggtcgtggtcccattcagcttacatggaactacaactatggcctggcaggatcacaagtcggcttcgacggcatcaacgatccggacatcgtttcgcgagacgcggtggtgtcgttcaagacagcgatctggttctggatgacgccacagaacccgaagccttcgtgtcacgacgtaattctggggaaatggaggccatccagtgccgacttagcagcgggaaggactgcgagctat

SEQ ID NO: 6120 - DNA, 621 bp, Artificial
  Synthetic
aaaaaggtcaaaatgagacttttggagttcacagctctgtcttctctactagtcttgtttctgctcctgcctgtctcggcagagcaatgcggtagacaggcgggaggtgcacgttgtccctcgggaatgtgctgcagcaactttggatggtgcggaaacactcaagactattgtggtccggggaagtgtcaaagccagtgtccttctggccctggacctaccccaagaccacccacccctcctggtcctagtactggggacatatccaacatcatcagcagttccatgtttaatcagatgctcaagcatcgcaatgacaatgcatgccaagggaagggcttttacacttacaatgcctttatcactgcagcaagatcatttcgtggcttcggcaccacgggtgacaccaccaggcgtaaaagggaggttgctgctttctttgcccaaacctctcatgaaactactggaggatgggatacagcaccggatgggagatacgcatggggttactgctaccttagggaacaaggcaaccctcctagctactgtgttcaaagttctcagtggccatgtgctcctggccaaaaatattacggaagaggccccatccaaatttcatac

SEQ ID NO: 6121 - DNA, 598 bp, Artificial
  Synthetic
gttaatataatcatatattcttattaaaataaaatcatgcataggggagtcttattcaattctcacaacatatatatgtaagcttcccaacaatggagcaattaataattaaaatctttggttattcttcaattcaacttctttaattacttggggtcctaacaagggagattatccccagtctccacacctagttgttgacaatactcagtataatactcaacccttctggcaacagtctgagggttgccgttgtcacattcaatccggccattaatggctcgaatggttgggccaaaaccttggccaaaagtgatgaaagaatggcaattgttcatccaataccacagggcagtcttgaaggaaataactgcatctttagccacaatgtccgggtcatttaggccatcgaatcctatggattttccagcaggtccatagttgaagttccatgatagttggatgggtcctcgaccgtagtactttttgcctgagacacaagggtactctgggttttcctcatcacaatagtcgcctgaaggaccatttatctcatttatgaagcacatgtgtccagtttcatgggtgacatgagcaa

SEQ ID NO: 6122 - DNA, 345 bp, Artificial
  Synthetic
cccacgcgtccgcaaaacatggctttcacaaaaatctccttagtccttcttctctgcctcttaggtttcttttctgaaactgtcaagtctcaaaactgcggttgcgctccaaacctctgttgcagtcagttcggttactgtggtaccgacgatgcatactgcggtgttggatgccgatcaggtccttgtagaggtagtggaaccccgaccggagggtcggtcggtagcattgtgacacaaggtttctttaacaatattatcaaccaagctggtaatggttgcgcggggaaaagattctacacccgtgactctttcgttaacgccgctaatactttccccaacttt

SEQ ID NO: 6123 - DNA, 645 bp, Artificial
  Synthetic
cttttcttctttattgtatagatatatactttacatacacatattctctctattcatagtcggtatggcagctaacggcgttagttctggtttaattgtgagcttcggcgagatgttgatcgatttcgtgccgacggtctccggcgtttcccttgccgaggctccgggtttcttgaaggctcctggcggtgcaccggcaaacgtcgccatcgcagtgactaggctcgggggaaagtcggcgttcgttgggaaactcggcgacgatgagttcggccacctgctcgccgagatactcaaaaagaacggcgttcaagccgacgggatcaacttcgacaagggagcgagaacggcattggcattcgtgaccctacgcgccgacggagagcgtgagttcatgttctacaggaatcccagtgctgatatgttgctcactcccgacgagttgaatcttgatgttattagatctgctaaggtgttccactacggttcgataagtttgatagtggagccatgcagatcagcacatttgaaggcaatggaagtggcaaaggaggcaggagcattgctctcttatgacccaaacctccgtttgccgctgtggccgtcggcagaggaggcgaggaagcaaatcaagagcatctggga

SEQ ID NO: 6124 - DNA, 879 bp, Artificial
  Synthetic
gcacccccgtgctatagatcttacatcgcagcagctgcaacagtaggaaaagaaaaacaatggccgctcagatcccgcagctctcgctgggactacagcagcagcggcaaaatctgtttttgggggataagccccagtgcttgaatttcaagagaaacagtagctctgcctcgaattgtctctcgtcatcaaatcaaggacatgtgagcagtgcgagagcgatggatatggcgagggatacgagctccaatctggtggtgtgtttcggagagatgcttatagactttgttcccacagtcgggggtgtctccctggcggaggctccggcgtttaagaaagctcccggtggagctccggcaaatgttgcggtcgggatctctcgccttgatggaaactccgcattcatcggtaagcttggtgaggatgaattcggcttcatgcttctggacatcctgaaggacaacaatgtagagagcaaaggcatgcgttttgatcccggtgcccgtactgctctcgcgtttgtgacgctccgcaaggacggcgagcgtgagtttatgttttaccgcaatccaagtgccgacatgctgctaaagccggacgaactggacgaagaccttatcaaacaggcctccattttccactacggttccatcagcctcatcgcagagccctgcagatcggcccacttggccgcgatgaaaatcgccagagaagccggggcgatcctttcgtatgatcccaacttgaggcttccattgtggagctcggcagaggcagcccggagcggcatcaaaagcatctggaacgaagccgacatcatcaagataagtgaggaggagatcactttcctgactgaaggaggcgatgcatacagcgatg

SEQ ID NO: 6125 - DNA, 649 bp, Artificial
  Synthetic
tccgctctactggaacagaacaactgcttcaattcttccgaaaattagggtttattgtctacaaattccatgttaccagcgattactccaacatttcacatcgtactttcccttttagttgctgaaatctaacgcctgatgtaactgtattagggtctcaatttgaaattcactatctcaactagtttctcagatcaaacactatatccctttctaccattctttaaaacttcatacagatatggctcttcttcattctcctactttctgcttcagtggagtttccacttcaagtcaagcttctagaagtttccctgcccctagaagatgcactgtgaaaccagcaccttttctctcccagtctcttcccttctttcctcgatgcaaacttcaaggaagagcattgccaagcgacaatgggccattagagaaggatgaatcttcccttgttgtatgctttggagaaatgctcattgattttgttccgaccacaagtgggctgtcattagctgaagcacctgcatttaaaaaggctcctggtggtgctccagctaatgttgctgttggcatttcccgtcttggtggttcctcagctttcattgggaaggttggtgaagacgaatttggttacatgcttgctgatattttg

SEQ ID NO: 6126 - DNA, 463 bp, Artificial
  Synthetic
taactgatttgaaacagagcacacgaaaagattttcttttcctctgaacaaagacatgacacaataaatttcgccaagtagctgcctcattacacaaattcagaccaaaatatccaccgcaaatccaagagcttcttattaataataatagtaaaaataaacgccaaaagttctcacacggaagcaactaacttagcacacaaaagacagacatgaacacacccaagcccctcctcttccttgtctaaaacgaagcagcaactaaattaaatcgacctaaaattccgaggcccccaatggcggcgatcgacgacgaaaccgaggagctctagttggctgccttgctgatgagctcatgcgcgacggcgacggtgggcagcgccgggatggcacccttcttggtggtgcagatggctccgcacgcgttcgaaaacttgagcgcctccctcagcttctcctcgtt

SEQ ID NO: 6127 - DNA, 1367 bp, Artificial
  Synthetic
ccccccccgatcgcttctcatcgcaaatcgcatcgacttcgatgcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtctccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgaccccaacgtccgcctcccgctctggccgtccgaggacgccgcccgcgccggcatcctctccatctggaaggaggccgacttcatcaaggtgagcgacgacgaggtcgccttcctcacccagggcgacgccaacgacgagaagaacgtgctctcgctctggttcgacggcctcaagctcctcatcgtcaccgacggcgagaagggatgcaggtacttcaccaaggacttcaagggctccgtccccggcttctccgtcaacaccgtcgacaccacccggcgccggcgacgccttcgtcggctccctcctcgtcaacgtcgccaaggacgactccatcttccacaacgaggagaagctgagggaggcgctcaagttctcgaacgcgtgcggagccatctgcaccaccaagaagggtgccatcccggcgctgcccaccgtcgccgtcgcgcaggagctcatcagcaaggcagccaaatagagctcctcggtttcgtcgtcgatcgccgccattgggggcctcggaattttaggtcgatttaatttagttgctgcttcgttttagacaaggaagaggaggggcttgggtgtgttcatgtctgtcttttgtgtgctaagttagttgcttccgtgtgagaacttttggcgtttatttttactattattattaataagaagctcttggatttgcggtggatattttggtctgaatttgtgtaatgaggcagctacttggcggc

SEQ ID NO: 6128 - DNA, 637 bp, Artificial
  Synthetic
cccccccccgatcccattccagtgaccaatccacactgatcccagtagctctcattgtcctcacgcttcgactcgcttgctagatctttgggttcttgtgtgttgtgatcgcgcgatgaggacggtggcgcttggcattgtggcgatggcctgcctggtggccattgcgcatggaggcaacttcttccaggacgcggaggtgtcgtgggggcagggccgcggcaagatcgtcgatggtggccgtgggctcgacctcacgcttgacaggagctccggctctgggttccagtccaagagcgagtacctcttcggcaagatcgacatgcagatcaagctcgtccccggcaactccgccggcaccgtcaccaccttctacttgtcgtcgcagggttcgacccacgatgagatcgacttcgagttcctggggaacgtgaccggcgagccgtacacgctgcacaccaacgtgttcacgcaggggcaggggcagcgcgagcagcagttccgcctctggttcgaccccacccagtccttccacacctactccatcatctggaacccacagcacgtcatattcgcggtggacgggacaccgatcagggacttcaagaaccacgaggcccgtggcgtggcgttcccc

SEQ ID NO: 6129 - DNA, 725 bp, Artificial; identical to SEQ ID NO: 4159
  Synthetic

SEQ ID NO: 6130 - DNA, 607 bp, Artificial
  Synthetic
aatcccaaacaaacaaaatacacagatacaagagaaacaaatagttgtctctgattggttaaagctttagaactttcaccatgggtgtaaaaggacttttgtttagtattgttttgattaatttgtcattactaggactttgtgggtatcccagaaaaccagtggatgtacccttttggaaaaactatgagcccagttgggctagtcaccacatcaagtacctcagtggtggttccactgttgatcttgttcttgacaggtcttcaggtgctggatttcagtcaaagaaatcatatttgtttgggcactttagcatgaaactgaagcttgttggtggagactcagctggtgttgtcactgcattttacctgtcatcgaataatgcagagcacgatgagatagattttgaattcttagggaacaggactgggcaaccatacattttgcagacaaatgtgttcacgggaggaaaaggagacagagaacagagaatctatctctggtttgacccaaccaagggttaccattcttattctgttctttggaataccttccagattgtgatctttgtggatgacgtcccaattagagcattcaagaactcaaa

SEQ ID NO: 6131 - DNA, 1038 bp, Artificial
  Synthetic
gccattacggccggggacacaaacaaacatcaaacattctaattactacaagtaaaattttatataagctaagggctaaaatggggtcaagaattttcttgattttagcacttgtgtttagttcttgcatggtttgttttggtggaaatttttttcaagaatttgactttacttggggtggaaatagggctaagattttcaatggaggtcagcttatgtctttgtctttggacaaagtttctggttctggttttcaatctaagaaagagtatctctttgggagaattgatatgcaaatcaaacttgttactggaaattctgctggaactgtcactacatactatttatcttctcagggacccacgcatgatgaaattgactttgaattcttgggaaatgttactggtgaaccttatattctccacacaaatatttatgctcaaggcaaaggaaacaaagagcagcaattctatctttggtttgatcctaccaaaaattttcacacctactcaattatttggaaaccccaacacattattttcttggtcgacaacacaccgataagagtttacaaaaatgctgaatcaattggtgtgccatttcccaagaatcagcccatgagaatttactctagcctttggaatgctgatgactgggcaacaagaggaggcctagtgaaaactgattggtctaaagcaccatttacagcctactatagaaatttcaattctcaaacttttggcagttcacagttttcaaatgaaaaatggcaaaatcaagaacttgatgctaatggtagaagaagactcagatgggttcagaggaatttcatgatttataattattgtactgattttaaaagatttcctcagggttttcctccagaatgcaaaagattctgagtgatattagtttgtttttgtgaaattcttttatgtgtttgtggttttattttgttagtttatagcgatcaaaataaatattgtatttttctcatttcattttatatgttatttgaagctagtcgttcatcttgta

SEQ ID NO: 6132 - DNA, 633 bp, Artificial
  Synthetic
acgcgtcgatctgctactactactgtgtactagccccatagctagaagtgtgccgccactatggctctcctccgtcctcttcctctcataatgattatagtaataatcacaatggcagccctgccttctcctatggttgccgtaccgctacccccccatagtagtttcacctctgatttctatgtcacctggtctccctcccaagtacagctccttaatgccggtcaggagctccaccttaccctcgacactaactcaggttctgggtttgcgtcgaagaatagctatttgtacggcaacattgacatgcaaatcaagcttgtgccagggaattcagccggcacagtcactgcttactatctatcatcagcgggggctaatcacgacgagctggacttcgagtttctggggaacacgacgggggagccgtacatagtgcagactaacgtgttcgccaacggagtggggggcagggagcagcgtatctacctctggttcgaccccactgctgacttccacacctactccgtctcctggaacaaacagcgcatcatcttccttgttgacggcacacccatccgcgtgtataccaataacgaagcattgggcgtcccttatcccaacaagcaaccc

SEQ ID NO: 6133 - DNA, 1078 bp, Artificial
  Synthetic
cacgcgtccgcccacgcgtccggacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatattccaggtggacgatgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcgccaacgcgtgcgtcaacaacaaccccgccggcgggtggtcgtcgtcgtcgtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgatgatgaacaaatcctccattgatgagttcttgaatgatttgtaattgcttcttgttcttgttcgtcttcgtcttcgtcttcttcttcttcttgatccatgtacattttgccatccattcgttctccattcgttacagttacagagacaggttgatggt

SEQ ID NO: 6134 - DNA, 641 bp, Artificial
  Synthetic
ccccccccccgaacccagttggtccagtcaccgtatcaattacctcaatggtggcaccacagctgagcttcttctcgacaaatcttcaggagctggatttcaatcaaagaaatcgtatctatttgggcactttagtatgaaaatgaagcttgttggaggtgattctgctggtgttgtctctgcattttatctgtcatcaaacaatgcagaacacgatgagatagatttcgaattcctagggaacaggacaggcgagccgtacatattacagaccaatgtgtttacaggaggtaaaggagacagggagcagaggatctatctctggtttgatccaaccaacgacttccattcatattccgttctctggaacacctttcaaattgtgatttttgtggacgacgtgccaataagagtattcaagaattcgaaagacataggtgtggcattcccattcaatcagccgatgaagatctattcaagcctgtggagtgctgacgactgggctacaagaggaggattagagaaaacagattggtcaaaagcgccattcactgcttcctacacttcattccacatagatggctgtgaggcattcaccccacaagaagtgcaagtttgtaatacaaatggcatgaaatggt

SEQ ID NO: 6135 - DNA, 695 bp, Artificial
  Synthetic
aatttacaaaaaactttgaaaaatgtcgcctcgtttctctttcaaaatgttaatccttcccatagtcatggcaagtctatgggcagccgcctctgctggtaattttaataatcttgcagagatcacttggggcgaaggacgtggtaaaataacagaaggaggcagaggcctctctctgtcccttgacaaattttctggttcgggttttcaatccaagaatgaatatctctttggaagatttgacatgcaactcaaacttgtccctggaaattctgctggcactgtcaccactttctttttatcttcacaaggagctgggcatgatgagatcgatttcgagttcttaggaaatgtttctggccaaccttatacagttcataccaacgtttattcacaaggcaaaggcaacaaagaacaacaattccatttgtggttcgacccaactgctgcatttcacacttactccattatctggaacgctcagaaaattattttcttggtagataataatccaatcagagtatacaacaaccatgaaaccgctggcattccattcccaaaaagccaaccaatgaaagtgtactgcagcttatggaatgcagatgattgggctacacaaggaggcagagtcaagactgattggacacatgctcctttcactgcttactacagaaacttcaatattgatggctgcg

SEQ ID NO: 6136 - DNA, 876 bp, Artificial
  Synthetic
ttatctaaaccattctcattctttacagttgtgaaaaatggtttctttttctatggcgtttagttgtgttgtctttggtatttctctaatgatgatgggtttggttagctcttcaagatttgaggagctgtatcagcccagttgggctacggatcatttgacaaatgaaggagaaattctcaggatgaaattggacaacctttctggtgctggattttcatcaaagaataagtatatgtttgggaaagttactgttcagattaagcttgtagaaggtgactctgctggaactgtcactgctttctacatgtcatcagagggaccaacccataatgagttcgattttgagtttctaggtaacacaactggtgaaccatactccgtacagaccaatgtttacgtaaatggtgtgggtaacagagaacaacgactgaacctttggttcgacccatccaaggaattccattcctattccatcttgtggaaccaacgccaagttgtattcttagtagacgacaccccagttcgtgtacactcaaatttggagcacaagggaattccatttccaaaggaccaagccatgggtgtgtacagttcaatatggaatgcagatgattgggctacacaaggcggaagggtcaagactgattggtcacatgcaccctttgttgcatcctacagaggatttgagattgatggctgtgaatgtccagcaactgttgcagctgctgagaattctaagcggtgcagcagcactgctgagaaaaggtattggtgggacgagccaacaatgtctgagcttagtctgcaccagagccatcagttgatttgggtcagggctaaccatatggtctatgattattgcacagacactgc

SEQ ID NO: 6137 - DNA, 1001 bp, Artificial
  Synthetic
tataaaaggactccttacgcaacctaaagaattatatatcatctactcatactcttatcttctcttcatcatttcaatggcttcttattgcttctaatttccattctaatgggcagcctagtcgctgcatcagctaattttaataatcttgcagagatcacttggggcgaaggacgtggtaaaataacagaaggaggcaaaggtctttctctgtcccttgacaaactttctggttcaggttttcaatccaagaatgagtatttattcgggaaatttgacatgcaactcaaacttgtacctggaaactctgctggcactgtcaccaccttctttttatcttcacaaggagaaggacatgatgagatcgacttcgagttcttgggtaatacgactggcgagccctacactgtccacaccaacgtgtattctcaaggaaagggaaacaaagaacaacaattccacctttggttcgacccaactgcagcatttcacacctacaccattgtgtggaacgctaaacgtatagtgttcttggtagataacatcccacttagagtatacaacaaccatgaaagcaatggcattccattcccaaagagccaaccaatgaaagtgtactgcagcttatggaatgcagatgattgggctacacaaggaggcagagtcaagactgattggacacatgctcctttcactgcttactacagaaacttcaatattgatggctgcgcagttacatccggtgcctcttcatgtaagtccactgactctgcaggcaatgctaacgcatggcaaaatcacgagcttgacgctcagggcaggaatagggttcgatgggtgcaaagtagacacatggtttacaactattgtgctgattctaagaggtttcctcaaggctattctcacgagtgcaagagctcaaggttttaattaggagatggcacttcgttatatcaactccaaaggtttaaagattgatgcatagcctggtggtttatggg

SEQ ID NO: 6138 - DNA, 657 bp, Artificial; identical to SEQ ID NO: 4161
  Synthetic

SEQ ID NO: 6139 - DNA, 673 bp, Artificial
  Synthetic
cccccgaaaacacaccattaatttccaggtttaatttgcagaatttagagaagcaagaaatctattacagttccattttcaaaattatggccagctctcgacttatttctttggctaatttgttcattttggcaattgcatttcatttggtttcagtcaatggaatgttctcagataacatgtatattaactggggtgcccatcattcttggatgcaaggaaatgatcttcagcttgtccttgatcaatccgcaggttcaggtgtacaatcaaaaggagcatttctttttggaagcatagaaatgcaaatcaaattagtatctggaaattctgctggaacagtcacagcatactatttgtcatctacaggtgacaagcacgacgagatcgacttcgagtttttaggaaatgtatcagggcacccatatattatccacacaaatatttttactcaaggtgcaggaggcagggaacaacaattctatccatggtttgatccaactgctgattaccataactataccattcattggaaccccagtgcagttgtatggtacgttgacggtataccaatcagagtattcaagaactatcagagccagggaattctctatccaaacgcgcaaggaatgaaggtttactctagcctttggaacgccgataactgggcaac

SEQ ID NO: 6140 - DNA, 837 bp, Artificial
  Synthetic
ccccccccgacacctccaattgtacaaggtcatacaattaacagaaaaacaatgggtaaattgacttccttaaaatattcagctgcaattctaatattgctatatgccttgaccttttccttctcagtgagtgcacgacccgccacttttttacaggactttaaggtctcttgggccgactctcacatcaaacaaatcgatggcggcagggccattcagcttattctcgaccaaaactcaggatgtgggtttgcttccaaaagtaaatacctctttggacgtgttagcatgaagatcaagctcgtgcctggtgactctgctggaaccgtcactgccttttacatgaattcagacacagacaacgtaagggacgagctagacttcgagttcttgggaaacaggtcaggccagccgtacactgtccagacgaatgtttatgttcatggaaaaggtgacaaggaacaaagagtcaacctttggttcgatccatcagctgattttcacacttataccattctttggaatcaccaccacgccgtattctacgtggactcagtacctattagagtgtataagaacaacgaagcaaaaggaatcccattccccaaattccaacccatgggagtgtattcaacattgtgggaagccgatgactgggcaacgagaggtggattagagaaaataaattggagcaaatccccattttacgcatactacaaggacttcgacatagagggatgtgcaatgccaggaccagcgaactgtgcctcaaatccacgcaattggtgggaaggagctaattaccaaccaatcagtgctgtggaagcaaggcaatat

SEQ ID NO: 6141 - DNA, 666 bp, Artificial
  Synthetic
tttgttttatacaaaaaatgatttcctcttccttaaaatattcaactgtcattgtaatattgctatatgccttgacattttcattttcagtgagtgcacgacccgccacttttttacaggactttaaagtggcatgggctgactcgcacatcaagcaaatcgatggcggcaaggctattcagcttatactcgaccaaaactcaggatgtgggtttgcttccaaaagtaaatacctctttggacgtgttagcatgaagatcaagctcgttcctggtgactctgctggaactgtcacagccttttacatgaactcggacacagataatgtaagggacgagctagacttcgagctcttgggaaacaggtcgggtcagccgtacactgtccaaacgaatgtttatgttcatggaaagggtgacaaggaacaaaggatcaacctttggttcgatccatccgctgattttcatacctacacaattctttggaaccaccatcacactgtattctacgtggaccaagtacccattagagtgtacaaaaataacgaagcaaaaggaatcccattccctaaattccaacccatgggggtgtactcaacattgtgggaagccgatgactgggcaacaagaggtggattagagaaaataaattggagcaaatctccat

SEQ ID NO: 6142 - DNA, 645 bp, Artificial
  Synthetic
gccctggagaaaggacgggaaaggttggaggtgctgagctctcatctggcactgccaatggcacaagaggaggccgctgccaagcttgctgcccctcttcactcccaagaagattccgaatatacacctaccatctttgacaagattctcaagaaagaaatcccatcaaattcagtctatgaggatgaactagtatatgcattccgagacatagctcctcaggctcctacccacatagtgataattcccaagaacagggatggattgacacagttatcaaaggctgaagagaagcataaggagatactcggacatcttctctattctgcaaagctgatcgctagtcaagaggggctctcaaatggctatagggtggtaataaatgatggaccagatggatgtcaatcggtgtatcatatccaccttcatctcatcggaggcagacgaatgacctggccaccgggctagtgagactgtggggtgtatcggttattgtttttgatgcttccggactggacaataaaactagactttaagcacttaaatcaaatattaggatgcttgaagtggcatttttgcccatactctgttgtctcttatattgctttttttagagagatgctctatgttctctatcctggtgtg

SEQ ID NO: 6143 - DNA, 728 bp, Artificial
  Synthetic
gagcgcgccagattggggaaagaatggcgggcggtggcggcgtcgaagaatctcgccccggcgaggaggtcgcggcgcaggcagcgtcgattttcaaggatacggcagccccgacgatattcgacaagctcatatcgaaggagatcccttccaagatcgtctacgaggacgataaggttttggcgtttagagacttaaacccacaggcaccgacgcatatcttgctcattcccaagcacagggatggattaacgcagctttccaaggctgaagagagacacaaagcgattttgggtgaactactctatgtttcgtctgtggttgccaaacaagagaaattggacgatggctacaggattgttataaacgatggccctcaaggatgccaatctgtgtaccaccttcatgtccatctcgttggaggacgccagatgaaatggccccctggctagaccagtaaacgttcaattttacaaagaatgcccaggaatggaaagtttcttttctctatgaacttggggcagtggaatcctgtgctgcgaaatccgggtaccttttcttcgtcaagccgtgaagccaccgagcaaacactccctcactggattccgtggaagcaatgtgggggtagatcacctcggccttgaactcggcaatctccttctcgaacaacttgagcgacacctcgtcgtgactttccgcaaacctctggttgtaagcggtgtacaagc

SEQ ID NO: 6144 - DNA, 635 bp, Artificial
  Synthetic
tttactactactcatcagaagaagaaacctgctgccatggcttccgagaaagaagctgctcttctcgccgttccttcagattcacctaccatatttgacaagatcattaacaaggaaatcccagcaaacattgtctacgaggatgacaaggttttagctttcagagacataaatccccaagctccagtgcacattctgcttattcccaaggtcagggatggtttgacgggactttccaaggctgaagaaaagcattgtgaaattcttggtcaacttctttacactgcaaagcttgttgctaaacaggaaggtctgctggagaatgggttcagacttgtgatcaatgatgggcctagtggatgccaatctgtttatcatcttcaccttcaccttcttgggggacgtcagatgaactggccacccggctaaaggaagccgagatgaattcctgatctcatggagtatccagactacatgcgatcacatatgtgtagcaccttactgaaaacactatcatctatgtgtagtgttcgaagaatcaagctcgaagcttatcctatgctcctatggagacacaggtctcattcagactattatgttgatcatcaataagagagatctccttaaactctttc

SEQ ID NO: 6145 - DNA, 775 bp, Artificial
  Synthetic
ccccccacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccgatccttgccccactgccaatcgggtttgcggtgttcttggttcacctggccaccatccccatcaccggcaccggcatcaa

SEQ ID NO: 6146 - DNA, 814 bp, Artificial
  Synthetic
gaattcagtaactttcgggctatttttggcaagaaaagtttcactaccaagagcagtcttgtacatggtggctcagtgtttgggagcaatctgtggtgttggattagtcaaggttttccaatcagcatactacgttaaacatggtggtggtgccaatacactttccgctgggtacagtaaaggaaccggtctagcagctgaaatcatcggaactttcgttcttgtgtacacagttttctcagccaaagattatcacgacccaccaccaacaccattctttgatgcagatgagcttaagaaatggtctttctacagagctattattgctgaatttgtagctactcttttgttcctttacatcactgttttgactgttatcggttacaaggctcaaagtgaaactgatgattgtggtggtgttggtattttgggtatcgcttgggcttttggtggtatgatcttcgtcctggtttactgcaccgctggtgtctccggaggacacatcaacccagcagtaactttcgggctatttttggcaagaaaagtttcactaccaagagcagtcttgtacatggtggctcagtgtttgggagcaatctgtggtgttggattagtcaaagctttccaatcagcttactacgttaaacatggtggtggtgccaatacactttccgatgggtacagtaaaggaaccggtctagctgctgaaatcatcggaactttcgttcttgtgtacacagttttctcagccactgacccaaagagaaacgccagagactcccatgttcccgttttggcaccacttccaatcggg

SEQ ID NO: 6147 - DNA, 637 bp, Artificial
  Synthetic
caccatctagctcactcacacagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctac

SEQ ID NO: 6148 - DNA, 341 bp, Artificial
  Synthetic
tccgtactaaagttcctgtggattgagaaaacaaaatggagaacaaagaagaagatgtaagattaggagcaaacaaatattcagagaggcaaccgattgggacggcagcgcagagtgacaaggattacacagagccaccaccagcgccactgtttgaggcaggagaattggtgtcttggtcattctatcgtgctggaattgctgagttcatggccactttcctcttcctttacatcactatcttaacagtgatgggtgtttcaaagtctgaatccaaatgctccactgttggtattcaaggcattgcttgggcttttgggggcatttctggaggacacata

SEQ ID NO: 6149 - DNA, 618 bp, Artificial
  Synthetic
ccgctctccgcatccatcagagaagagagaggtagagaagagagagcagagctaagctagctcagagtgagtagcgtgttgagcttgctgaagggagcggcaatgtcgaaggaggtgagcgaggagccggagcacgtgcggcccaaggactacaccgacccgccgccggcgccgctgttcgacgtcggcgagctccggctgtggtccttctaccgggcgctcattgcggagttcatcgccacgctcctgttcctatacatcaccgtcgccaccgtcattgggtacaaggtgcagtcgtccgccgaccagtgcggcggcgtcggcaccctcggcatcgcctgggccttcggtggcatgatcttcatcctcgtctactgcaccgccggcatctccggagggcacattaaccccgcggtgacgttcgggctgctgctggcgaggaaggtgtcggtgattcgcgcggtgatgtacatcgtggcgcagtgcctgggcggcatcgtgggcgtgggcatcgtgaagggcatcatgaagcaccagtacaacgccaacggtgggggcgccaacatggtggccagggggtactccaccggcaccgccctcggcgccgaaatcatcggc

SEQ ID NO: 6150 - DNA, 638 bp, Artificial
  Synthetic
agcaaagaggtcccccctcttcttctctatcgtagttttccttttggaactcatccaattcacgagggagaggtagaactgatcaagagaaagagatggcgaaggatgcaggaaaagagtccgaagccttcgtcaccgccaaggactacgaagatccaccgccggtgcggctcgtagatccaaaagagtttgcttcctggtccttctacagggccggcattgccgagttcgtcgccacgctcttgttcctctacatcaccgttcagacggtcatcggccactcgcgaaaccaggcaaactgcggtggcgtcgggttgctaggaatcgcatgggcctttgggggcatgatcttcgttctcgtctactgcaccgccggaatctcaggaggacatatcaacccggctgtgactttcggactcctcgtggctcgcaaggtctcgctgcctcgcgcgatcttctacatgatcgcgcagtgcctgggagcgatcgtcggctgcggcctcgccaaggggttccagaggagcttctacgtccagcaaggtggaggagcaaactctgtcgcgaatggctacagcataggaaccggacttggagctgagatcattggaactttcgtgctcgtctacaccgtcttctca

SEQ ID NO: 6151 - DNA, 890 bp, Artificial
  Synthetic
agtggggccaacctctacgttaaaagatggagcttctctttaactttgcttaggcagcttatccagcagcagcatcttccttttctctctctctttcccttctctctctctcatccctttccagacacttctcggggtttaatcagggcacgcgagagatatcgagaggtagagagttaagttcttcctgtgttccaaagcttggaagctagactagatcgatcatccgatggaaggcaacagggaggatgttcatgttggtgtggcaaagtatcacgagcgagagctgggaaccgcggcacaggccgaaaaggactacgttgagccggccccgacccggctgatcgagccgtccgagttctcgtcctggtccttctggcgagccggaatagcggagttcttcgcaaccttcctcttcctctacatcaccattctcacggttgtggggaacgttaaccgtactagctgcaacggggtggggatccaaggcatagcctgggcctttggaggcatgatctttgctctcgtctactgcaccgctggaatctctggtggacacatcaatcctgcggtgactttcggcctcttcttggctcgaaaggtgtctctgcctcgaaccattctctacatggttgcacagtgcctgggggcgatttgcggtgccggcgtcgtcaaaggcttccagagggcgatgtttaacgctgctggaggaggagcgaacttcgtccagcatggttacacacttggagatggtctaggagctgagattgttggaacttttgttctcgtctacaccgtcttctcggctactgatgctaagagaagtgccagagattcccatgtcccggtgctggctccacttcccattggctttgcagtgtttctagtcc

SEQ ID NO: 6152 - DNA, 692 bp, Artificial
  Synthetic
cccccccgaagctctccgctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccg

SEQ ID NO: 6153 - DNA, 486 bp, Artificial
  Synthetic
gaattcgaaaccaaagaaaattttcatttcttgacagaaatggtgttgaaatggagggcaaataagaggatgttaagttgggagcaaacaagttctcagagagacaaccaataggaacttcagcacagaacacagataaagattacaaggaaccaccaccagctccattttttgagcctggtgaactaaaatcatggtcattctggagagcaggaattgcagagttcatggctactttcttgtttctttacatcactgttttgactgtcatgggtgttgctggtaacaagaataagtgtgcaactgttggtatccaaggtattgcttgggcttttggtggtatgatctttgctcttgtctactgtactgctggtatctctggtggtcacatcaaccctgctgttacctttggacttctattggcaaggaaattgtctctaacaagagctgttttctacatgataatgcaatgtcttggagcaatct

SEQ ID NO: 6154 - DNA, 717 bp, Artificial
  Synthetic
cccacgcgtccgagcacacacaaaaaaaaaaaacagcaaaccaaaaactcaaaactcttctccttcactgccaacttctaaacagaagtacttttactttcatcaaaaaaaacatgtcaaaggacgtaattgaagaaggacaaactcatcaacatggaaaagactatgttgaccctccaccagctcctcttcttgacatggctgaacttactaaatggtccttttacagagctgttattgctgagtttattgctactcttctcttcctttacgtcaccgtcgccactgtcattggccacaagaagttgaacgctgctgaccattgtgatggtgttggcattcttggtattgcatgggcttttggtggcatgattttcgttcttgtttactgcactgctggtatttctggtggtcatataaacccagcggtgacatttgggttattcttggcaaggaaagtgtcattaataagagctgttgcatacataatagcacagtcacttggtgctatttgtggtgttggttttgttaaagcttttatgaaacattactacaacttagaaggtggaggtgctaactttgtacaacctggttacaacaagggtacagctttaggtgctgagattattggaacctttgttcttgtttacactgttttctctgctactgaccctaagagaagcgcgcgtgactctcacgtccctgttttggctcctc

SEQ ID NO: 6155 - DNA, 396 bp, Artificial
  Synthetic
aaaaaaagctattgtttgaaagaagaagaagttaactatggcaaaggatgtggaagccgttcccggagaaggatttcagacaagagactatcaagatccgccaccagctccgtttattgatggagcggagctaaagaagtggtctttctacagagcagttatcgcagagttcgtagccactctcctcttcttatacatcaccgttttgacagtcatcggttacaagattcaatccgatactgatgccggtggcgtaaattgcggcggagttggaatcctcggtatcgcttgggcctttggtggtatgatcttcatcctcgtatactgcaccgccggtatctctggtggtcacattaacccagcggggacatttgggctattcttggcacgtaaagt

SEQ ID NO: 6156 - DNA, 345 bp, Artificial
  Synthetic
aaaaagctcacaactttaacctttctggagagagaagaacaaaagagggagagggagagaaatggaaggcaaagaagaagatgtacgagtgggagctaacaagttcccggagaggcaacccatcggtacatcggctcagtccaccgacaaggactacaaagagccacctcctgcgccactgttcgagcccggcgagctcagctcatggtctttctacagagccggaatagctgagtttatcgctactttcttgtttctctacatcactgttttgactgtaatgggagttaagagagcaccaaacatgtgtgcttctgttggaatccaaggtatcgcttgggcttt

SEQ ID NO: 6157 - DNA, 789 bp, Artificial
  Synthetic
cccacgcgtccggagaagcaaaagaaaaaaaagctattgtttgaaagaagaagaagttaactatggcaaaggatgtggaagccgttcccggagaaggatttcagacaagagactatcaagatccgccaccagctccgtttattgatggagcggagctaaagaagtggtctttctacagagcagttatcgcagagttcgtagccactctcctcttcttatacatcaccgttttgacagtcatcggttacaagattcagtccgatactgatgccggtggcgtagattgcggcggagttggaatcctcggtatcgcttgggcctttggtggtatgatcttcatcctcgtctactgcaccgccggtatctctggtggtcacattaacccagcggtgacatttgggctattcttggcacgtaaagtgtcgttacctagggccctattgtacataatcgctcagtgtttgggtgcgatttgtggagttggttttgtcaaagccttccaaagctcttactacacccgttacggaggtggagccaactctctagccgatggctacagcacagggaccggtctagccgcagagatcattggtactttcgttcttgtctacaccgtcttctctgccactgaccccaaacgtagtgccagagactcccacgttccggtgttggcgccacttccaatcggatttgccgtgttcatggtacatttggctaccattcccattaccggaaccggaattaacccggcaaggagtttcggagctgccgtaatctacaacaagagca

SEQ ID NO: 6158 - DNA, 390 bp, Artificial
  Synthetic
cacagaaaaacctagaaagctctagagagaaagagagagagagatggaaggtaaagaagaagatgttagagtcggagctaacaagtttccggagaggcaaccgatcggaacttcggctcagagtgacaaggactacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctactcaccgctggtatctccggtggacacatcaacccagcg

SEQ ID NO: 6159 - DNA, 344 bp, Artificial
  Synthetic
attggagttgttgttgtaatgggtattacggcaagcaaagacgtggaactagatccgactgcaatccctcctccagacggcaacgaggagtactcagatccaccaccagttcctctctttgaaagccatgaattcgtcctctggtctttctaccgtgcttgcatcgccgaatttatggccacttttctctttctctacgttgcccttgctactgtcattaccgatcaccataacaaagctaattgcggcagtgtcggtgtgcttggcatcgcctgggctttcggaggaacgatcttcatcctcgtctactgcactgccggaatctcaggagggcacattaaccc

SEQ ID NO: 6160 - DNA, 294 bp, Artificial
  Synthetic
cgacccacgcgtccgaaagaacaaagatgtcgaaagaagtgagcgaagaaggcaaaacccaccatggaaaagactacgtggatcctccaccagctcctcttctcgacatgggtgagctcaaatcctggtctttctacagagctctcatcgctgagttcatcgctacactcctcttcctctacgtcaccgtcgctactgtcatcggccacaagaagcaaaccggtccttgtgacggcgttggtttacttggtatcgcttgggctttcggtggtatgatcttcgtcctcgtctact

SEQ ID NO: 6161 - DNA, 712 bp, Artificial
  Synthetic
aaaaaaaacagagcatcctctgtttctttctacagagtattttacttttttcttttctaagttatgactaaagaagtagaggcagtatctgagcagcctgcggagtattccgctaaggattacactgatccgccaccaactcctcttgttgattttgaggagttaactaaatggtcactttacagagcttgtattgctgagtttattgctactttgttgtttctttatgtaactgttttgactgtgattgggtacaagcatcagtcggatactaaagatggaggcgatatatgtggcggcgttggtattcttggtattgcttgggcttttggtggcatgatctttgttcttgtttactgcactgccggtatctctggtggacacatcaaccctgctgtgacatttgggctatttttggcaaggaaagtatcattgatgagggcagtattgtacatggtatcacagtgcttgggtgcaatatgtggtgtgggttttgtgaaggctttccagaaagcttactaccatagatatggtggtggtgttaatgttatggcaggaggccacaacaaaggtgttggtttgggtgctgagattattggtacctttgttttggtctacactgtcttctctgctactgaccctaagaggagtgctagagactcccatgtccctgtattggaccacttccaatcggattcgctgtcttcatggt

SEQ ID NO: 6162 - DNA, 751 bp, Artificial
  Synthetic
cactacattctcctctcttaaaattagcagggctcaaatttaatttcttatgagtatattttttggtgaacaaatggctaaagacactgaagttggcacagaatacgccccaaaggactaccaagacccaccccctgcacccttaattgaccctgaggagctaggaaaatggtcattttacagagccataatagctgaattcatagccactttattatttctctacattactgtcctcactgtgattggatacaagagccaaattgaccctgaccataagggtgaagaatgtggtggtgttggaattcttggaattgcatgggcatttgggggcatgatttttgtccttgtttattgtactgctggtatttctggtggacatattaaccctgctgttacatttggactattcttggctaggaaattttcattggttcgtgccattatgtatatgttggctcagtgtttaggagccatttgtggttgtgggttggttaaggcatttcagaaggcgtactatgttaagtatggtggtggtgctaatacgttgaatgatggttatactacaggtacaggtttgggtgctgaaattattggaacttttgttcttgtttacactgtttttgctgctactgatcctaagagaaatgctagagattctcatgttcctgtgttggcaccacttccaattggatttgctgtgttcatggttcatctggctacaattcctgtaactggaactggtattaac

SEQ ID NO: 6163 - DNA, 318 bp, Artificial
  Synthetic
cccacgcgtccgaagaagaagaagaaaaaaaacagagctttacaatttctctctacagagatcgaagatatggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtgct

SEQ ID NO: 6164 - DNA, 842 bp, Artificial
  Synthetic
cccatacccaacttccttttttggattccatttacagagagagagggaaagcttagttgagtgactgaagaaaaaaatggcagagaacaaggaagaagatgtcaagctaggagcaaacaagtacagagaaactcaacccttgggcacagcagctcaaacagacaaggattataaggagccaccaccagctcctttgtttgagccaggagagttgtcatcatggtctttttacagagctggaattgcagaattcatggctactttcttgtttttgtacatcactatcttgactgttatgggtctcaaaaggtcagatagtttgtgttcttctgttggtattcaaggagttgcttgggcttttggtggtatgatctttgctcttgtctactgcactgctggtatctcaggaggacacattaacccagcagtaacatttggtctgttcttggcaagaaagttgtctttaacaagggctctgttttacatggtgatgcagtgccttggtgcaatctgtggtgctggtgttgttaaaggttttatggtgggtccatatcagagacttggtggtggggccaacgtggttcaacctggctacaccaaaggtgatggacttggtgctgagattattggcacctttgtccttgtctacactgttttctctgccactgatgccaagagaaatgctagagattctcatgttcctattttggcacctcttcctattggattcgcggtgttcttggttcatttggccaccatcccaatcactggaaccggcatcaaccccgcccggagccttggagctgctatcatcttcaaccacgaccaggcatgggatgatc

SEQ ID NO: 6165 - DNA, 912 bp, Artificial
  Synthetic
cccacgcgtccgaaacaagaaaaatccttctagtgtgtgtctgtgtgtgtgaaaaaaatggcagaaaacaaagaagaagatgtgaatcttggagcaaacaaatacagagaaacacaacccttaggaacagcagcacaaacagaaaataaagattatgttgaaccaccaccagcaccattatttgaagctggtgaattatcatcttggtcattttacagagctggaattgctgaatttatggccactttcttgtttttgtatattacaatcttgactgtaatgggacttaagagatcagatagtttgtgttcttctgttggtattcaaggtgttgcttgggcttttggtggtatgatctttgctcttgtttactgcactgctggtatctcaggaggccacattaatccagctgtgacatttggtctgttcttagcaaggaaactttccttaaccagagcagttttctacatggtaatgcaatgccttggtgctatatgtggtgctggtgttgttaaaggttttatgaaaggtccataccaaagacttggtggtggtgctaatgtggttaaccctggctatactaaaggtgatggacttggtgctgaaattattggtacttttgttcttgtttacactgttttctctgctactgatgccaagagaaatgccagagattcacatgttcctattttggcacctcttcctattggatttgctgtgttcttggttcatttggccacaatcccaattaccggaactggcatcaaccctgccaggagtcttggagctgctattatcttcaacaaaaaacaggcatgggatgaccattggatcttttgggttggaccattcattggagctgctcttgctgcagtttatcaccaaattattatcagagccattccattcaag

SEQ ID NO: 6166 - DNA, 657 bp, Artificial
  Synthetic
gtcaatctctctctccccttatacaatacaagtagaaggccatggagtcgaaggaggaggatgtgagactaggtgcgaacaagtacccagagaggcagccactgggcacggcagcgcagacgcggaactacagtgagcccagcccggcccccctcatcgagccctcggagttctcctcctggtccttctggagagccggcatcgccgagttcatcgccaccctcctcttcctctacatctccatccagaccgttatgggatggaagcgctcagtcgaggccgagaccgccaaattccccaatgaccagaacatctgtcctcagggtgtcggcgtccagggcattgcctgggcctttggcggcatgatctttgccctcgtctactgcaccgccggcatttcaggtgggcacataaacccggcagtgacgtttggactattcctggctcggaagctgtctctaccgcgggcgttgctatacataatagcacagtgcctgggagccatctgcggggcgggcatcgtgaaggggttccaggaggcagactaccagcgctttggaggtggtgctaactcagtggcccatggctacaccaaaggggatggcttgggggctgagatcattggcacttttgtcctcgtctacaccgtcttctctg

SEQ ID NO: 6167 - DNA, 621 bp, Artificial
  Synthetic
gagacttgagtatcgagtgaagaagaagatggcgagcaaagacgtggaattggtgagtcatgggagtgggaaggattacacagatcctcctccggctccgcttttcgacaccagtgaattcgccaagtggtcgttttacagagcttgcatagcggaattcgtagctactctgctctttctctacatcacagtagctactgtcataggggatcaaaacaatgtagcgaattgcgggaacgtaggggttctcggcatagcctgggctttcggtggaatgatcttcattctcgtttactgcactgccggaatctcaggtgggcatatcaaccctgctgtcacttttgggttgttcctcgcacgcaaggtttcgctccttcgtgccgtcgcctacatcgtggcgcagtgccttggtgccatttgtggcgctggtctcgttaaggggttccagcagggttactatgtccgatatggtggcggtgctaactctgtggctgaaggttacagcaaaggtgttggccttgctgctgaaattattggaacttttgtccttgtttacaccgtcttctctgcccactgaccccaaacgaagtgcccgtgactcacatgtgccgatattggccc

SEQ ID NO: 6168 - DNA, 546 bp, Artificial
  Synthetic
cgaccaaacttggtttttgcactatccacttagcacaaaaaaaagagaaaaacaagctaagtttagtgagtgttcaaatggcagaaaacaaagaagaagatgttaagcttggagctaacaaattcagagaaacacagccattaggaacagctgctcaaacagacaaagattacaaagaaccaccaccagctccattgtttgaaccaggggagttatcatcatggtctttttacagagctggaattgcagaattcgtggctactttcttgtttttgtacatcactatcttgactgttatgggtcttaagagatctgatagtctgtgtagttcagttggtattcaaggtgttgcttgggcttttggtggtatgatctttgctttggtttactgcactgctggtatctcaggaggacacatcaacccagctgtgacctttggattgttcttggcaaggaaactgtccttaaccagagctattttctacatagtgatgcaatgccttggtgcaatttgtggtgctggtgttgtgaagggattcatggttg

SEQ ID NO: 6169 - DNA, 645 bp, Artificial
  Synthetic
aaacagagcagcaacagagtgttgaacagttagtgatgggaaaagacgtagaagcagcaacagagttttcagcaaaggactacacagacccgccaccagcaccgttgattgattttgaggagctgaaacaatggtccttttacagagctgctattgctgagtttattgccactttgttatttctgtatgtaactgtactgactgtcattggatacaagcaccaatcggacgttgatgctaatggcgatgtctgtggcggcgttggcatccttggtattgcctgggcatttggtggcatgatctttgttcttgtttactgcacggccggtatctctggaggacacattaacccggcagtgacatttgggttgttcttggcaaggaaagtgtcacttatcagggccttggtgtatatggtagcacagtgcttgggtgcaatatgtggtgtgggttttgtgaaggcttttcagagcgcttactatgacagatatggtggaggtgctaatcagatggctcctggccatacaaagggtgttggtcttgctgctgagatcattggtacctttgttttggtctacgttgtcttctctgccactgaccccaaaagaagcgcccgagactcccatgttcccgtattggctccac

SEQ ID NO: 6170 - DNA, 822 bp, Artificial
  Synthetic
ccccccgaagctctccgctcagctaagctctgcaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccgccaccgaccccaagcgcaacgcccgcgactcacatgtcccggtcttggcgccgctgccaatcggcttcgccgtgttcatggtccacctggcgacgatcccgatcaccggcaccggcatcaacccggccagg

SEQ ID NO: 6171 - DNA, 716 bp, Artificial
  Synthetic
ctcatcttcttcagaaaatcagaagaaaggaaaaatgtcaaaggacgtgatagaagaaggacaagttcatcaacaacatgggaaagattacgtggacccaccaccagctcctttgcttgattttgcagaactcaagctctggtctttttacagagctcttattgctgagttcattgctactcttcttttcctttacgttactgtcgccactgtaattggtcacaagaagttgaatggtgctgatcaatgtgatggggttggtattcttggtatttcttgggcttttggtggcatgatatttgttcttgtttactgcactgccggtatctctggtggacacattaacccagcagtgacatttgggttattcttagcaagaaaagtgtcattattaagggcagtgggatatattattgcacaatctttaggtgcaatttgtggtgttggtttggtgaaaggtttcatgaaacattactacaacacgttaggtggtggtgctaattttgtgcaacctggttataacaagggcacagctttgggtgctgagattattggaacttttgttcttgtttacactgttttctctgctactgaccctaaaagaagtgcccgtgactcccatgtccctgtattggccccactgccaattggatttgctgttttcatggttcatttggctactattccaattactggaactggtattaaccctgcta

SEQ ID NO: 6172 - DNA, 622 bp, Artificial
  Synthetic
ttcttcatcttcttcttcttcttcctccttggtccatatatacacaccaagctaggtgtggttggcttggttgtctgagttgtgtgttgggtgggttggtaccatagtgtgtgttggttggttagttgtggtgttggcaggagggggattattatggagtccaaggatgaggatgttagactcggggccaacaagtaccccgagcggcagcccattggtaccgctgcccagacccgcgattacaccgagccccgcgctgcccctttcgttgagttctcggaattctcctcctggtccttctggagagctggtatcgctgagttcgtcgccaccctcctcttcctctacatctccgtccaaaccgtcatgggatggaaacgctccgtcgcggcctccaacctgaaattccccggtgacgtcaacatttgcccgcaaggtgttggggtccaaggcatcgcttgggcctttggtggcatgatcttcgccctcgtctattgtaccgctggtatatcaggtggacatattaacccagcggtcaccttcgggctcttcctagccaagaagctgtctctaccccgcgctttgctttacatcattgcccaatgcttgggtgccatttgtg

SEQ ID NO: 6173 - DNA, 686 bp, Artificial
  Synthetic
accaaatataagatcccggaacagagaccaaaatagaaactactgtgagaagtgagagtagtaggcagcccatctcgccggcgccgatctgcagattcaccggcgaatcaaattccccgttgctgttaggtggattaagtggaaagagaggaaccagagataaattatggtgttctctacggtgatgagttgttcacctcatatgtgtcttccaaagagccgcatggttatgcagaaaacactccggtgctctgcttctgtttcaacagcgtctgagtccatccaatttgatcttaagaattattggacaactctaattcgtgatatcaaccagaagcttgacgaggcagttcctgttaagtaccccaatcagatttatgaggccatgcgctactccgttctggccaagggtgctaaaaggtccccgccaatcatgtgtgtcgcggcttgtgagcttttcggtggaaatcgccaggctgcctttcccactgcctgtgccttagagatggttcatgctgcttcattgattcatgatgatctgccttgcatggatgatgacccaactcgtcgagggctgcctgcaaatcacacagtttttggtgtagatatggcaattttggccggggatgccttattcccgcttgggttccagcatattgtgtctcacactccaagtgatctcgttc

SEQ ID NO: 6174 - DNA, 707 bp, Artificial
  Synthetic
gggtcgcagggcaattcctctaagcacgaggcgatggggaatgagtggttggagacagggaactgtcctatcgccaaatcttatagagctgtgagcagtgtcctcccacttgtggcaacagcttttcagctgcctcctgtaatgaagctcaaatgcccatctgcagttgttgcagccagggctgcccttgccaggactgcctttgtgaagactctgcggccacaaccgctatcttcaaagatgcttgttattggagccttgggtatggcagccaatattccactaggcatatggagagagcacactgagaagttctcaccatcttggtttgctgctgtccatgctgctgttccttttatagctatgctgaggaagtcggttgtgatgcccaaaacagctatggcattaaccattgctgcttctatcttaggacaggtcattggctcaagagcagaacgacttcgaatgaaagcaaaagccaagagtcttaaattggtagcgcagactggctcagatgggattattgcaggtctcaactcgatccaggtcaatggtatgcattgtggcaaacaggggatgattaaagatcaatcctcgaatgattcgggcaaccctatcactccatctgccagtctttgtttctaaaggaggtttatagaactggtaaataagcagtagaaccataagctgcatataaaaagtgtcag

SEQ ID NO: 6175 - DNA, 554 bp, Artificial
  Synthetic
ccattaaccggaaatttattaaggaaacagtcccattcattttcacacaattttgtaaaaggcaacaaccgtataaatgtcaaaacattgcttgagggacccccgtaactactaatgttattaacggggcccaattaaaaaacaaaagaccctttatttacccttaacaactgggacaggacatgttgcttttgccaccacatgattgctcacactacccagcaagatctttttgaaaaaacccaaaccttgattgccaaaaacaagggaatcgagttttaaattttcaacagcatcacaaagtttctcctttggatctccccaatacacctttgttacaaccttcacttttttacccctaaagagagtttcaaaaacttcaaaaccctcaggatcgtaagcaagtccttactgtttaaacaaattaacctttttaaattcctccaaaggaattagcggggaaccggtttcctcaaaaaggattttgcggttataaccggcgttttggggttggacgtaaatcaaaataacggggtccccgttttaaaggaaat

SEQ ID NO: 6176 - DNA, 603 bp, Artificial
  Synthetic
gaaagagagagagagagagagagagagagagagaggaagaagaagaggatccattgagtgaaagagtagtatgggttgtaggcaggtgggagtggcgctggacttctcggtcagtagtaagaatgcgctcagctgggctctccataacatcgcaaggcccggagataaagtctttctcatcatcgtctctaagaaggatcgtgatatcgctcagtttgacctatgggaagactctggctctcctcccattcctgtatgtgagttcgagcaaccttcaacagcaaggaattatggcgtagcatcagaccaggaagtaatcaacatcttaaaggaatacgaaagcaagtgcaaggaggttgaaattcttttcaagatttattggggtgatgcacgagagaagatttgtgatgcttgtactgctctacctctcgattgcattgtgatgggaagtcgagggcttggagctctcaaaaggactttgttgggtagtgtgagcaattatgtggtcaacagtgcaccttgccctgtaacagttgtcaagccacctactcacgagtgtgaatgatatgagtgtccatgaaaatgagattattggagcaaaat

SEQ ID NO: 6177 - DNA, 680 bp, Artificial
  Synthetic
tcttctgtttccctctattacaggcgacatttcctgtggctactcaagcaagtagctggtagagaagggcattctctctttcatctctttgctgcaaaatggaggggaggcggattggggtggctatggacttctcgcccagcagcaggcacgccctcaaatgggctctctgcaacatcgcccgaaagcacgaccatttgatcatcatcatcgtcaacaagaaggagatggaatcgggtgacatgctcctctgggagcaatctggttctccattgatacccttctgtgattacgctgaaccggccgtcacccacaagtatggaattcagcatgatgttgacctcttctcacttgttgaagacgagaaaaatatgaaggaactcactgtagttttcaaagcgtattggggtgatccccgcgagaagatatgcgacgcttctgtagaccttccccttgattgccttgtgatgggaagtcgaggacttggaaccttgaaaagagcccttctagggagtgtcagtaactatgtagtcaacaattgcccatgcccggtcactgtcgtaaagtttccagccgacgatgtgcattcctcttgaccaattccaacatacaaggaggaaataagaactgaggtacatcaacatataaataaaacctttgatttcatagctatggggcta

SEQ ID NO: 6178 - DNA, 623 bp, Artificial
  Synthetic
tttccttcctagtcagcttcttctccttcctaattaccctcttctctttttcttctctttccttccttccccctatcaatggcagagcggcgcattggaatggctgttgacttttctgcctctagcaaatatgcggtcgaatgggggctgaagaacattgcccgtaagcatgaccatgtcatcatcatcgtcgtcaacaagaccatggacgtcgagtctggcaagatgcacctctgggaggagtctggatctccattgatacccttctctgacatcgccaatccaaaagttatagacacttacggaattccacatgatattgatctactctctctcatcgaggatgaaaaaaatataaaggaactcagtgtagttttcaaggtctattggggggatgcccgtgaaaagatatgcgatgctgcggtggacgttccccttgattgtgttgtcatgggaagcagaggccttggaactctcaaaagagcccttctcgggagtgtgagtaactacgtagtgaacaattgcccatgcccagtcaccgtcataaagcttcctgtgagcgacatcggctcttcttgaatcaattcacacacacatatatatatatatatataatataaata

SEQ ID NO: 6179 - DNA, 735 bp, Artificial
  Synthetic
cgggccaaaaagcccataggattattcaatgaaaactacaatctacaactttttcacatcaaagttttgaagtagaagtaaatcaaaagaaaagaagaatagacatgaaacagccaaaggtacccattgacattcatcctgcagacttttattcatccccctttgccaatttctcccaaccacaaaccacgctcatctaggaaaaactaatctttttttaagagaaatattatacattcaagattttaagcatctgctgtctcagcattatccgctgcagccaagataagctccggatgaatggtcgactctgctgtcccgtcgagtgcattgggcaatcccaatgcccttagcgcaaggtgggccgccttctgccctgatatcatcatagctccaaaagttggccccattcttggtgctccgtcaatttcagcaacttccatccctgtgacaatcattccaggtacaacctctcttgtaagtctaacaatagcatcctcagcggcgttcatgtccaaagctttcatcccaggaacatgattgatcatgccaatgctcttaagcctcttaacaccagtggcacccatgggaccgtcgtggccacaagagctgaccacaatcttagcctccataacattggggtccatgcaagattgtgtgtcatggttctgagaaaggagattttgttttgagaccttagaagaatgaaagattgttttccccggccgtaatggc

SEQ ID NO: 6180 - DNA, 1124 bp, Artificial
  Synthetic
cggacgcgtgggcggacgcgtgggcggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgttttttttttcgggatttgctttgatccccttgtttgttttagctctggatgttgattagcgtcttgttcatagcaattccactgccaccgtgtgtgtgtgctctgcttgcctgatgagggcaagaaaacttccatggatccgtctctctgggagga

SEQ ID NO: 6181 - DNA, 680 bp, Artificial
  Synthetic
ttttttttttttgagaacttaaaccctaaaatccaagcaaaaccaaaccacataaaaacatccttcacataagaaagaaaaaacaaaagaacaaccatgaacagcagacagactatttgattgacggatttctcttaacctacagtactcatcaacatcatcatcatatccttgctctgctctctttttattaatttatgcaattttagatgataatttccttatcatcaacagtctcaacattactttatttcttaagcttcagcagtctcagctgattcagcagctgcaaggataagctctggtacaatacctcccatgtcactgtagtttccatcaataacattaggttgtcccaatgccttcagtgctaaatgtgctgccttttgccctgagatcatcatggctccgaatgttggtcccattcttggggcaccatcaatttcagccacttccattccagtaacaatcataccaggaacaatttctctagtgagtttaacaatggcatcttcagcggcgttcatgtcaagagctttcattccaggaactgagtcgattaaaccaatactcttcaaccttttaacaccagtagcaccaaaaggaccatcatgaccacatgaactgacaacaatcttggcttccatgacattagggtccatgcaagattgtgtgtcatg

SEQ ID NO: 6182 - DNA, 1009 bp, Artificial
  Synthetic
gaattcacaactcatcttaaacacagaagcgcggaacctaagaaatcttctttctaatggcaaccatggcaatgaccctttcttcacccctttctaaaacacctttcctagaaactcaatcttctttccatgggatccagatcccatcaagattccaacccatccgatcaacttcccaaaacaacactacatcatcaatctctatgtcatcaacttccggttatgatcttacagatttcaagtttgcaccaatcagagaatcaatagtttctcgtgaaatgacccgtcgttacatgatggatatgattacttacgccgataccgatgttgttgtcgttggtgctggttcagctggtttatcatgtgcttatgaaatcagtaagaaccctaacgttaatgttgcacttattgaacaatcagtttctccaggtggtggtgcttggttaggtggacaacttttctctgctatgattgttcgtaaaccagctcacaaattcctcgatgaactcgaaatcgagtacgatgagcaagacacctatgttgtcatcaagcatgctgccttgttcacttccaccatcatgtcaaagttgttggccagaccaaacgtcaagttgttcaatgctgttgcagcagaggatttgatcgttaagaacaataaagttgccggagttgtcaccaactgggcgttagtctcaatgaaccatgacacacaatcttgcatggaccctaatgtcatggaagccaagattgttgtcagttcatgtggtcatgatggtccttttggtgctactggtgttaaaaggttgaagagtattggtttaatcgactcagttcctggaatgaaagctcttgacatgaacgccgctgaagatgccattgttaaacttttctctgctatgattgttcgtaaaccagctcacaaattcctcgatgaactcgaaatcgagtacgatgagcaagacacctatgttgtcatcaagcatgctgccttgttcacttccaccatcat

SEQ ID NO: 6183 - DNA, 326 bp, Artificial
  Synthetic
tgatcgtgaagggcaagagggttgcaggtgtggtaactaactgggccttggtttcgatgaaccatgacacacagagctgcatggacccgaatgtgatggagtcgaaagttgtcgttagctcctgtggccacgacggccccttcggggccaccggcgtgaagaggctcataagcatcgggatgatcgacaatgtgccggggatgaaggccttggacatgaacacagctgaagatgctattgttcgtttgactcgcgaggttgttccagcaatgattgtcaccggcatggaggttgctgagatcgatggtgcaccccgcatgggacca

SEQ ID NO: 6184 - DNA, 383 bp, Artificial
  Synthetic
gagaggctcaagagcattggtatgattgatagcgttccggggatgaaggccctggacatgaacactgccgaggatgccatcgttcgattgactcgtgaggttgttcctgggatgattgttactggcatggaagttgccgagatcgatggagcgccgaggatgggaccgactttcggcgcgatgatggtctcgggccagaaggcagctcatctggctttgaaggcactggggttgccaaatgccatagatgggacgctcaaggctggatatgttccagagcttgtgcttgcctcggccgaggaccaggagaccaccacggcttactcgctttgctcgagaaaatctttgtattctcgagtggacgatggtcttccacgcgaatg

SEQ ID NO: 6185 - DNA, 691 bp, Artificial
  Synthetic
ttatatcacctacaattaacatggccccacctcctgctgtcgttgcccaccccctctcctctcaggctactggtcttgatatggtccatgagttcaaccagaagctcactaagtctgatgagcacacttgggagtctttcaagttcgcccccatccgtgagtccactgtctctcgagctatgactcgacgatactttgaggatcttgacaagtacgctgagtctgatgttgttatcattggagctggctcctgtggtctctctgctgcctatgttcttgccaagagccgacccgacctcaagattgccatcgttgaggctggtgttgctcccggaggaggtgcttggcttggaggacagctcttctctgccatggttatgcgaaagcctgccgagcagttccttgaagagatcggtgtcccttacgaagatgagggagactacgtcgttgttaagcacgctgcccttttcacctctactctcatgagccaggtgctcaagttccccaatgttaagctcttcaacgctactgccgttgaggacctcattacccgaaaggatgcccagggcaaccttcgaattgcaggtgtcgtcaccaactggaccctagtttccatgcaccatgatgaccagtcctgtatggaccccaacaccatcaatgctcctatcatcatctccaccactggtcatga

SEQ ID NO: 6186 - DNA, 680 bp, Artificial
  Synthetic
gatacgatcgcatgctctccttctcgctgcctctccaaggcccacgaatctcccctcgcatcctctcgctcctccatcgcggggacgaggatcaaggtaaactccctttcggccgccgccgtcccgcgcagcttctcgcatggatccgccagcgcgcgctacgacctcaacaacttctccttcgagccgatcaaggagtcgctggtggcccgggagatgacccgccgctacatgaccgacatgatcacctacgccgacaccgacgtcgtcatcgtcggcgcgggctccgctggtctctcgtgcgcctacgagctgagcaagaacccggacgtgaatgtcgccatcgtggagcagtccgtgagccccggcggtggtgcatggctcggcggccagctcttctccgctatggtcgttcgcaagcccggtcatgtcttcctggacgaggtcggcgtcccctacgacgagctggagaactacgtggtggtaaagcatgccgcgctcttcacgtcgacgatcatgagcaaggtgctggagaggcccaacgtcaagctcttcaacgcggtggcggccgaggacttgatcatcaagcaggacaaggttgccggggtggtgaccaactgggcactggtttctatgaaccaccatacacagagttgcatggatcccaatgtgatggaggc

SEQ ID NO: 6187 - DNA, 1216 bp, Artificial
  Synthetic
aaaaaactcatctctcaagatctcaagctttgtctatggcaaccatggcatcaaccttggcatcctctgttgttaccaagaccaatttcttggacacccacaaatcatctttctctggtgtccctcttttttcacaagctagacttaaacctgttaaatctgcccagcaaaacatgaccatttccatgtctgctgattcctctcctccaccttatgatcttaacgctttcagttttaacccaattaaggaatccatcgtttctcgcgagatgacacgtaggtacatgactgacatgatcacctatgctgacactgatgtcgtcatcgttggcgctggctctgctggtctctcttgtgcttatgagatcagcaagaaccctaacgttcaggtggccatacttgagcaatcagtgagccctggtggaggtgcctggctaggaggacaactcttctcagccatggttgtgaggaagccagcacatctcttcttgaacgagctcggcatagactatgacgagcaagataactacgtggtcatcaagcacgctgccttgttcacctcaaccatcatgagcaagcttttggccaggccaaacgtgaaactcttcaatgctgttgcaacagaggaccttattgtgaagaacggaagagttggtggtgttgtcactaactggtctttggtttctcagaaccatgacacacaatcctgcatggaccccaatgttatggaggctaagattgtggtcagctcttgtggccacgacggtcccatgggtgccactggtgttaagaggcttaagagcattggcatgatcaaccatgttcctgggatgaaagctttggacatgaacaccgctgaggacgctattgttagacttacccgagaggttgtacccggaatgatcgtcacagggatggaagtcgctgaaatcgacggagcaccaagaatgggaccaacttttggagctatgatgatatcagggcagaaggcagcccaccttgcgctaagggcattgggattgcctaatgcactcgacgggacagcagagtcaagcattcatccggagcttatcttggctgcagctgatgatgccgagacagcagatgcttaaaatctttaatgtataagatttctctaaaaaagagattagttttttcctaggtgagcgtggtttgtggttgcgagaaattggcaagggggatgaataaaagtctg

SEQ ID NO: 6188 - DNA, 1144 bp, Artificial
  Synthetic
gcgaactcctacagctgcaatagtaacaagcaattattggcgccccaccagctactggtcggagatgacacatctttgagtatttttctcgcaggtatagtttcttcatctcatgatctttgcatttcctatcatcagattttgtctccctaactttctatgtggccatacttgagcaatcagtgagccctggtggaggtgcctggctaggtggacaactcttctcagccatggttgtgaggaagccagcacatctcttcttgaacgagctaggcatagactatgacgagcaagataactacgtggtcatcaagcacgctgccttgttcacctcaaccatcatgagcaagcttttggccaggccaaacgtgaaactcttcaatgctgttgcaacagaggaccttattgtgaagaacggaagagttggtggtgttgtcacgaactggtctttggtttctcagaaccatgacacacaatcttgcatggaccccaatgttatggaggctaagattgtggtcagctcttgtggccacgacggtcccatgggtgccactggtgttaagaggcttaagagcattggcatgatcaatcatgttcctgggatgaaagctttggacatgaacgccgctgaggatgctattgttagacttacaagagaggttgtacctggaatgattgtcacagggatggaagttgctgaaattgacggagcaccaagaatggggccaacttttggagctatgatgatatcagggcagaaggcggcccaccttgcgctaagggcattgggattgcccaatgcactcgacgggacagcagagtcgaccattcatccggagcttatcttggctgcagcggataatgctgagacagcagatgcttaaaatcttgaatgtataatatttctcttaaaaaaagattagtttttcctagatgagcgtggtttgtggttgggagaaattggcaaagggggatgaataaaagtctgcaggatgaatgtcaatgtgtacctttggctgtttcatgtctattcttcttttcttttgatttacttctacttcaaaactttgatgtgaaaaagttgtagattgtagttttcattgaataatcctatgggctttttggcgtcgttttggtaaaaaaa

SEQ ID NO: 6189 - DNA, 687 bp, Artificial
  Synthetic
tcccagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggcggggccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaagagggccgcgtcggcggcgtggtcaccaactgggcgctggtgtcgatgaaccacgacacgcagtcg

SEQ ID NO: 6190 - DNA, 357 bp, Artificial
  Synthetic
atttagaaggataacagcattaagagtgacgcgtatatacgcgtcacaaggcccgactaaaccgtcaaaaccatctccaggagtagacacaagaatccactgggaaagcccggacgaaggctggatcggaggaagatccgacccggccaaatcggttgatgaggacaaaaccaatctccttagtgacgaaaaatttgcagaactaatcaaagactcttttgattctcattaccaattcttaggtgtttcaacggatgctgatctagaagagataaaatctgcgtaccggagattatctaaagagtatcatccagatacaacttcactaccacttaaaacagcttcagaaaagttcat

SEQ ID NO: 6191 - DNA, 747 bp, Artificial
  Synthetic
tctcccttctctttttgcaagacttaataattctccagcttcctcccatcatcaccccactttgagagagaagacatggcaaagggaagttacgagaaggccattgtttcactccagaacctcctcagtgagaagggagaactggaaccgattgtagcagaaagaattgatgaaatcacagctgaattacaaacgtcaggcttccaatcagtccaccctgttgacagaatcaagactggctttgattatttcaaaaaagagatatatgacaaaaatccagaactgattgatgaactcaagaaaggacaggaacccaagtttctggtgtttgcatgctccgattcacgagtgagcccatctcatgtgctgaattttcagctcggtgaggcttttatggttcgaaacattgccaacatggtccctccttatgacaagacaaaatactcgggagtaggagctataatcgaatatgctgttctctttcttaaggtagaaaatattttagtcattggccatagtgcatgtggaggtattaaggctctcatggatctcccagaaaatggttctgaatcaaccgattttattgagaattgggtgaaaattggactaccagccaaggcaaaggtactagctgaacatggggacaaaacttatgaagagaaactcaaatactgtgaaatggaagctgtgaatgtatcactagctaatttgctgacatacccatttgtgagtgatgctttggtgaat

SEQ ID NO: 6192 - DNA, 1077 bp, Artificial
  Synthetic
cccccggcgtgtgtagctactgctataaggagcgcgccgtgcaccgcctctcacaatggcgaccgccgccgccgccgccgctgcccagagctggtgcttcgccactgtcaccccgcgctcccgcgccacagtcgtcgccagcctcgcctccccatcaccgtcctcctcctcctcctcctccaacagcagcaacctcccggcccccttccgcccccgcctcatccgcaacacccccgtcttcgccgcccccgtcgcccccgccgcgatggacgccgccgtcgaccgcctcaaggatgggttcgccaagttcaagaccgagttctatgacaagaagccggagctcttcgagccgctcaaggccggccaggcacccaagtacatggtgttctcgtgcgccgactctcgcgtgtgcccgtcggtgaccatgggcctggagcccggcgaggccttcaccgtccgcaacatcgccaacatggtcccagcttactgcaagatcaagcacgctggcgtcgggtcggccatcgagtacgccgtctgcgccctcaaggtcgaactcatcgtggtgattggccacagccgctgcggtggaatcaaggccctcctctcactcaaggatggagcaccagactccttccacttcgtcgaggactgggtcaggaccggtttccccgccaagaagaaggttcagaccgagcacgcctcgctgcctttcgatgaccaatgcgccatcttggagaaggaggccgtgaaccaatccctggagaacctcaagacctacccgttcgtcaaggaggggatcgccaacggcaccctcaagctcttcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtact

SEQ ID NO: 6193 - DNA, 613 bp, Artificial
  Synthetic
gggctaccccgacacagatcttgagtccgccattcaagccctaacccagctcttgcagcaatctccggggttgaaagcagaagcagtgaagaagattgaggaaatcacgtcagagctttcccttgttgaagaacataagaacgggaaggagatcgaccccgtgctcaagctcaagcatggcttctccaagttcaaatccttcttcaagaaagaagctgaattgttcaagagtcttgcggagtcacaacaccctaagtttatgatcattgcatgctcggattcaagagtagatcctgctgtcatccttaatttgggtctaggagaagccttcattgttcgcaatgtcgccaatatggtgccaccttactgggagagtgctggatcttccactgcttctgccctagagtacgcagttttgcacttgaagattgaacacctgatggtgatcgggcatagtaggtgtgggggcatcaaagccctcatgtcatccaaggaagatgggtcaaacaaattcagtgactatattgaagactgggtcaaccatggaagaggtgctgctaagaaggtgcaaaagtccctccccaacaacaattttgacgaccaatgcaccaat

SEQ ID NO: 6194 - DNA, 699 bp, Artificial
  Synthetic
gggttcgaaccggagcaccgccaatatgaaatagcttttgcgcttctgcaaatactattatgataaacgacacgaggttcgcgcagtctataaatggaggctgaacccaggaaggcttcaggaatgtggagttgctgccttcccttgaaatcttctcgagaaatcaaaccctccactgcagtctcagctctccctgctcagcagaataagatgggtcaattcgatagcagtgattctgaatacacttccgccattgaagccctctccaccctcttgaagaaatcccccagcttgaaggcaacagcagtccagaagattgaagagttgactagcgagctaagccagaacgcagagacctgcaaggacgatttagtcgatcccttgcaaaaactcaagctcggcttctccaagttcaaatctttctacaaaaaagaggcggagatgttcaagagtttggcagaatcccagcaccctaagttcatgataatagcgtgctcagattcgagagtcgatcctgccgttatattgaacctgggtttgggagaagccttcatagttcgcaatgtggccaatattgtgccacccttctgggagagttctggatcatccacagcgtctgcccttgaatacgccgtcctccatctgaaggtggagcatctcatggtcattggtcacagtaggtgcggcggaatcaaagcg

SEQ ID NO: 6195 - DNA, 1014 bp, Artificial
  Synthetic
  misc_feature (941)..(941): The residue at this position can be any nucleotide.
cggacgcgtggggtctattgctaaaagaaggcatcacatttctggttcctccttcaatatgactttattctccacaaatatacgtgaggttaccaaaatggcagaggattcatatgaagacgccattgcaggactgaaaaagctcctcagtgagaaaaatgagctggaagatgcagcggtcgcaaaaatacggcagttgacggcagagttgggaagtgccggcgggaaaaagtctgacccggatgagaagatccgaaccggattcgcccaattcaaggccgaaaaatatgagaaaaatcctgagttgtttgggcagcttgcaaaaggtcaaagccctaagttcttggtattcgcctgctccgattctcgagtatgcccatcccacatcctcaatttccagccaggtgaagcttttgtggtccgtaatattgcaaacatggtccctccttttgatcagacaaaatattctggagtaggtgccgcagtcgaatatgcagttgtccacctaaaggtggagaatattttggtgattggacacagctgttgtggaggtattaaagggctaatgtctatccctgatgatgggtccacaaacagtgatttcattgaagaatgggtcaaaatctgtctgcctgccaaagcaaaagtaaaggcagaatgctgccatttggatcccactgaacaatgcacaaaattggagaaggaggcagtgaatgtatcactaggcaacttattgacatatccatttgtaagagaagctgtggtgcagaaaagccttgcgctgaaaggtggacactacgattttgtgaatggttcttttgagctctggaatattgacttcaatcttaccccttctgtttcactctaaactcttgcacactgtaacttgtcatgtaaccaatgcaactccgtttcaagtttttttcttcaacttttcattntgatgtaaatgtattccttactgaacaatgtgtgtcacacaaataatattaaccggctgttggagctttgggc

SEQ ID NO: 6196 - DNA, 1170 bp, Artificial
  Synthetic
aagagtaataaaagcaagcaaaagctaaaaaggaagttgttgagccaaatgtcaactgcttccattaacagttgccttactatctcccctgctcaagcttcccttaaaaaaccaactcgtcctgttgcttttgctagggttagcaactcttcttcttctccttttgttcccagtctcatcagaaacgagcccgtcttcgccgcccctactcccatcatcaaccccattttgagagaagaaatggcaaatgaatcctacgagcaggccattgctgcactcgagaaactcctcagcgagaaaggagaacttggaccaattgctgcagcaagagttgaccagattacagctgaattgcaatcatcagatggcagcaaaccatttgaccctgttgagcacatgaaagctggctttattcacttcaaaactgagaaatatgagaaaaacccagccttatatggagaactatcaaaaggccagagccccaagtacatggtctttgcctgctctgactcacgagtgtgcccatcccatatcctgaacttccaacctggtgaagctttcgtggttcggaacattgccaacatggtccctgcttatgacaagaccagatactctggagtcggagcagctatcgaatacgctgttctccaccttaaggtagaaaacattgttgtcattggccacagcgcttgtggaggtatcaaaggtctcatgtctctacccgcagatggttctgaatcaactgcctttattgaggattgggtgaaaattggtttacctgccaaggccaaggtgcagggcgaacatgtggataaatgttttgcagatcaatgcacagcttgtgagaaggaagctgtgaatgtatcacttggaaatttgctgacctatccatttgtgagagaaggtttggtgaagaaaacactagcattgaagggaggtcactatgattttgtgaatggaggatttgagctgtggggacttgagttcggtctttctccttctctttccgtatgaacttaaccaccgttttaagtggttttttcccctaacacttttgctttcatgtaatttcccaaatcgaactgtatgttgttgtatgtatgtattgaccaatatcaaagagcaccagttcttacatttctgaataaataaaatgcgagttcttccttt

SEQ ID NO: 6197 - DNA, 418 bp, Artificial
  Synthetic
acgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttg

SEQ ID NO: 6198 - DNA, 318 bp, Artificial
  Synthetic
catttatgcgcaaacggagcttgttttcggtgcacctgcttcagccacttcaaacttgaactgagaaggatgggaaacgaatcatatgaagacaccatcgaagctctcaagaagcttatcattgagaaggatgatctgaaggatgtagctgcggccaaggcgaagaagatcacggcggagcttcaggcagcctcgtcatcggacagcaaatcttttgatcccgtcgaacgaattaaggaaggcttcgtcaccttctagaaggagaaatacgagaccaatcctgctttgtatggtgagctcgccaaaggtcaaagccca

SEQ ID NO: 6199 - DNA, 331 bp, Artificial
  Synthetic
cggacgcgtgggcggacgcgtgggcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttacaccttaaggtggagaacattgtggtgataggacacagtgcatgtggtgggatcaaagggcttatgtctttccccttagatggaaacaactccactgacttcatagaggactgggtcaaaatc

SEQ ID NO: 6200 - DNA, 755 bp, Artificial
  Synthetic
ttaaaaggaaattcttgagccaaatgtcaactgcttccattaacagttgccttactatctcccctgctcaagcttcccttaaaaaaccaactcgtcctgttgcttttgctagggttagcaactcttcttcttctccttctgttcccagtctcatccgaaacgagcccgtcttcgccgcccctactcccatcatcaaccccattttgagagaagaaatggcaaacgaatcctaccagcaggccattgctgcactcgagaaactcctcagcgagaaaggagaacttggaccaattgctgcagcaagagttgaccagattacagctgaattgcaatcatcagatggcagcaaaccattcgaccctgttgagcacatgaaagctggctttattcacttcaaaactgagaaatatgagaaaaacccagccttatatggagaactatcaaaaggccagagccccaagaccagatactctggagttggagcagctattgaatacgctgttctccaccttaaggtagagaacattatcgtcattggccacagtgcatgtggaggtatcaaaggtctcatgtctctacctgcagatggttctgaatcaactgcctttattgaggattgggtgaaaattggtttacctgccaaggccaaggtgcagggcgaacatgtggataaatgttttgcagatcaatgcacagcttgtgagaaggaagctgtgaatgtatcacttggaaatttgctgacctatccatttgtg

SEQ ID NO: 6201 - DNA, 643 bp, Artificial
  Synthetic
acgcgtcgcttccatgccttcgatgcagcggtcccagggcctccccagccccgaatttccgtcctgggatcgttcttccggtagctacgcgtctcggctctggaatgcggcggccggattggggagaaggacctgtttcttgcagcaggttgttcatcaggatggtcaccaggttgttcatcaccagaagacgctggcagcggaaaggattaagcggggttttcaagggtttaagcaagacacataccgtcaaaaaccggagctcttcggtcgattagctatcggacagcatcccaagttcatggtgattgcttgctctgactctagagtttgtcccacgacgatcctgaggttccagccaggagaggcatttgtcatccgcaacattgcaaacatggtgcctcctccggaaaaggtacactgaccttgctttgtgctcgttcgctcagctcaaaggcaaggctttcaggctggctatccaggaaccagtgcagctctcgagtacgcagtcatggttctcaaggtcgagaacattctagtgattggacatagtcgctgcgccggtatcgaagctctgatgacacgcaacaccaagtggaggtcagtcttacgaagctacgtaccaaggactcgggctctttct

SEQ ID NO: 6202 - DNA, 578 bp, Artificial
  Synthetic
tttcctctatctctctctctcatcctctcttgttctctctctcatccccaagcaatggcttctctctcatggtcatcagctagcccatttgccttgccccaacaatggacctccatgtatagaaaattggccactctaccaccttcttctacctcatcctcctctccattgcccaagattagtgcagtacaagaggctcttcacccaattgagaaaataaagcaaggatttgagactttcaagcaaaccaaccttttgacaaggccagaagtgcatgaaccactgaagtctggccaaaccccaaaggtgatggtgatctcgtgctccgattcaagagtatgcccaacccaagtatttggattggatgcaggtgaagcatttgtggttcgaagtgtcgccaacttgattccaccttttggagaggaaggcttccctggcactagtgcagctctagagtacggtgttctccatctcaaggtagaacatatctttgttgttggacacagcatgtgtggaggaatcaaagctctcatgtcaattccagatgatgcacctaaatccacattgttcatcgaaga

SEQ ID NO: 6203 - DNA, 992 bp, Artificial
  Synthetic
cctggtgtgtagctactgctataaggagggcgccgtgcaccgcctctcacaatgtcgaccgccgccgccgccgccgctgcccagagctggtgcttcgccactgtcaccccgcgctcccgcgccacagtcgtcgccagcctcgcctccccatcaccgtcctcctcctcctcctcctcctccaacagcagcaacctcccggcccccttccgcccccgcctcatccgcaacacccccgtcttcgccgcccccgtcgcccccgccgcgatggacgccgccgtcgaccgcctcaaggatgggttcgccaagttcaagaccgagttctatgacaagaagccggagctcttcgagccgctcaaggccggccaggcacccaagtacatggtgttctcgtgcgccgactctcgcgtgtgcccgtcggtgaccatgggcctggagcccggcgaggccttcaccgtccgcaacatcgccaacatggtcccagcttactgcaagatcaagcacgctggcgtcgggtcggccatcgagtacgccgtctgcgccctcaaggtcgaactcatcgtggtgattggccacagccgctgcggtggaatcaaggccctcctctcactcaaggatggagcaccagactccttccacttcgtcgaggactgggtcaggaccggtttccccgccaagaagaaggttcagaccgagcacgcctcgctgcctttcgatgaccaatgcgccatcttggagaaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtacc

SEQ ID NO: 6204 - DNA, 676 bp, Artificial
  Synthetic
acgaagaaggaagaagaagaaggaacaagaacggaaaagtggctggttctcatgacagcattcttcgttggagagaatttcgctgctggaagccgtctcctccggacaagacgatggatccaatcgcgcttatctcgatgtggtggtccggaggtttcttccatgccttcgatgggcctccccagccccgaatttccgtcctgggatcgttcttccggtagctacgcgtctcggctctggaatgcggcggccggattggggagaaggacctgtttcttgcagcaggctgctcatcaggatggtcaccaggttgttcatcaccagaagacgctggcagcggaaaggattaagcggggttttcaagggtttaagcaagacacataccgtcaaaaaccggagctcttcggtcgattagctatcggacagcatcccaagttcatggtgattgcttgctctgactctagagtttgtcccacgacgatcctgaggttccagccaggagaggcatttgtcatccgcaacattgcaaacatggtgcctcctccggaaaaggctggctatccaggaaccagtgcagctctcgagtacgcagtcatggttctcaaggtcgagaacattctagtgatcggacatagtcgctgtgccggtatcgaagctctgatgacacgcaaacaca

SEQ ID NO: 6205 - DNA, 1045 bp, Artificial
  Synthetic
ggaggcggtccagatagcttcttcgtgaccccgggagctatacttgaccccttgtctggtcgattcatcgagagaacgaagtcgctgtccaattcaatcggtcttgaaagaatggcgccagagaaaacgttcgaggaggcgcaggagattcttctccacaagatcaagatctctccgaatctaaagccgattgccgcaaagaagctgctggatctcgccaaggagctggatggtggagaggacgaagagaaggtggcggatttatccctggtcgatgttccagcggcagagagaatcaagcagggatttacaaagtttaaaaacgggttctggctcaaaaatcagaagctttacgagaagctttcaactggccagtcaccgaagttcatgatcttcgcttgctccgattcgcgagtttctccaacgacgatcttgggtctacaacccggcgaagcattcgttgttcgcaacattgcgagcatgattccagcttgtggtgagactggatttccaagcactagcgctgctctcgagtatggagtcttacacctcaaggtggaacatattctagtgatcggtcacagtcgctgtggaggaatcaaagctttggtcaccactgaccccgagaacaaatggagtgacttcatccaagactggatcaaaatctcgacttgcattcgttcgagccaagattcttcgcaggatgtcgacgagcgatgcgcctgcggtgaaacggattcagttaacgtttcgctccgcaatctcatgacttttccatggatcaaatcggcagtggaaggtggaaagttggctcttcacggtggccactacagctttgtcgctggaacctttcagtactggactctcggcggcgataaagccaagttctaaaagccacgcacaagtctcatatatagatatatatacatatatctataaacgaagatgagtggcgaaggagaatcataacaacgaacaagataagaacctttaattcaggaacacatagacttctccacaatttccttgagctgtccagactgga

SEQ ID NO: 6206 - DNA, 852 bp, Artificial
  Synthetic
gggagaacggaaaagtggctggttctcatgacagcattctttgttggagagaatttcgctgctggaagccgtctcctccgaacaagacgatggatccaatcgcgcttatctcgatgtggtggtccggaggtttcttccatgccttcgatgcagcggtcccagggcctccccagccccgaatttccgtcctgggatcgttcttccggtagctacgcgtctcggctctggaatgcggcggccggattggggagaaggacctgtttcttgcagcaggttgttcatcaggatggtcaccaggttgttcatcatcaggatggtcaccaggttgttcatcatcaggatggtcaccaggttgttcatcaccagaagacgctggcagcggaaaggattaagcggggttttcaagggtttaagcaagacacataccgtcaaaaaccggagctcttcggtcgattagctatcggacagcatcccaagttcatggtgattgcttgctctgactctagagtttgtcccacgacgatcctgaggttccagccaggagaggcatttgtcatccgcaacattgcaaacatggtgcctcctccggaaaaggctggctatccaggaaccagtgcagctctcgagtacgcagtcatggttctcaaggtcgagaacattctagtgatcggacatagtcgctgcgccggtatcgaagctctgatgacacgcaacaccaagtggagttcgttccttgaagactggatcgagattggacatcctgctcgtgccacaacgctcaagacatcttctcagcgagagaaagaacaccagtgcacgagatgcgagaaggaatcggtgaacgtctctctg

SEQ ID NO: 6207 - DNA, 1021 bp, Artificial
  Synthetic
ggtgaagtctgtggggaagaaatctagggttagaaggccctgcgccaggaagcggcccaagggtagttagaaccagcacttcgcggcgcaccactgacgagttcttcgcgacttttttggtagcgtattggaatttggggcgattctagttctcgcaatggcggcaacgcccagtggcctccagaccagggtcgggaagtatgagctgggaaagacgatcggcgagggcaatttcgccaaggttcggcgagccaggaatctcgacactggcgagatcgtggcgatcaaggtcctcaacaaagaggaggtgatgaagcacaaaatggtcgagcagctcaagcgggagatttcgaccatgaagctagtaaagcatccaaacattgtccagctccacgaggttctggccagcaaaactaaagtttacatcgttttagagtacgtcactggtggagaactttttgacaagatcgtgaaacaaacccgcttgaaagaagacgaagcaaggaagtatttccagcaactcatcaatgcagttgactattgccacagcaggggtgtgtatcaccgcgacttgaagccggagaatttgcttctcgataaaaatggaaacttgaagatctctgacttcggtttgagtgcgcttccgcaacatcttcggccggatggtctacttcacactacttgcggcactccaaactacgtagctcctgaagtcataaacaacaaaggatacaacggggccactgcggacttgtggtcgtgcggtgtgattctttacgtcttgatggctggatttttaccttttgaagagcccaacctgatgaatttgtacaaaaagatcttccgcgcggatttcaagtgtccaaagtggtttagcagtggggcgaagaacctgatttgtaaaatactgcatccaaatccaaaatctcggattacgattccacaaattctcgaggacgagtggttcaaggtgggctacaagccagcaaagttccttgaggaagatgctgctcatctgaaa

SEQ ID NO: 6208 - DNA, 944 bp, Artificial
  Synthetic
gggtagtagcgggaatgtgctggatcgtttagctggggcttggagaggcgatggatcaggagcagcagctggcgcagcagcagccggccaggaggaatgaattcctgcactacaagctcggcaaaactctgggcattggatcgtttggcaaggtgaagatcgcggagcatatactcaccgggcacaaggtcgcgatcaagatcctcaaccgcaggaagatcaaagccatggaaatggaagagaaagttcgcagagagattaaaatcctgaggttgtttatgcatccacacatcataaggttgtatgaagttgtggagacgagcacagacatttacgtggtcatggagtacgtcaagtcgggagagctcttcgactacattgttgagaatggtcggcttcatgaagatcaagctcgacgtttctttcagcagattatatcaggcgtcgagtactgccatagaaacatggtagttcatcgtgatctcaagccggaaaatctgctcctcgactccaaatggaacgtaaagattgcggactttggcttaagcaacattatgcgagacggacatttccttaaaactagctgtggaagtccaaactatgctgctccagaggttatctctggcaagctctatgctggaccagaggttgacgtatggagttgcggcgttattttgtatgcacttctttgcggcagccttccatttgacgatgaaaacattccaaaccttttcaagaaaattaagggtggcatctacactctaccaagtcatctctctgccggtgcaaaagatttaatcccgcgtatgctagtggttgatcccatgaaacggatgactatagcggagattcgtgagcatccttggttccaagtcaatcttcctcggtatcttgcggttccgcccctggacaccgccgagcaagcgaagcggatcgatgaagat

SEQ ID NO: 6209 - DNA, 591 bp, Artificial
  Synthetic
gcagcagcaacttgatggcaccgtgggaaagctggggccgggggactttgagctgctcaatctcgtggggcagggggcgtttggcaaggtgttccaggtccgcctcaaggggagtaccgacatctacgctatgaaggtgatgaggaaggataaggtgctggagaagaactacgccgactatatgaaggccgagcgagacatcatgacgaagatagtgcacccgttcattgttcagctgcgctgctccttccagaccaagaccaaactgtacctcatactggacttcataaacggcgggcatctcttcttccagctatatcgtcaaggaactttcagcgaggatctgtgccggctttatgcagctgaaattgtgagtgctgtggcacaccttcactccaaaggcattgtacatagggatttaaagcctgaaaacattcttctcgacgctgatggccatgtgaaactcacggatttcgggttagcgaaggaaatcgaggactctggccgaacaaattcgtactgcggcacggttgagtatatggcgcccgaaatcctacttgcaaagggacacggaaaggaagccgactggtg

SEQ ID NO: 6210 - DNA, 628 bp, Artificial
  Synthetic
gcaaagtgttagaaccagagtcggtaagtatgagatcggcaggacactcggggagggtacttttgcgaaagtcaagttcgccaagcacatcaaaactggacatggtgtggctatcaagattttggacagagatagggttctcaagcacaagatggtcgagcagatcaagcgagaaatttcgacaatgaaacttgtgagacatccgaatattgttcaaataaaggaggttatggccagcaagtcgaaaatctatattgtcttggagcttgtcacaggcggtgaactctttgataagatcgtccatcaaggcaggctcaaggacgacgaagcaaggaaatattttcagcagctgatcaacgcggtggactactgccacagtcgtggagtataccaccgtgatttgaagcctgagaatctgctgctagactcaagcgggaatcttaaaatatcggattttggtctgagcgctcttcctcagcaactccgggccgacggcttgctgcatactacttgtggaactccaaactacgtgtcgcccgaggtgatcaatgacaaaggttacgacggagcgaaagcagacttatggtcctgcggggttatcctttttgtcctcatggctggctatttg

SEQ ID NO: 6211 - DNA, 723 bp, Artificial
  Synthetic
ggagctaggggaacgatcacaactttgaagagatgagcttccaaagcaaagtgatgagaactcgcgtcgggaagtacgagctgggaagaactcttggagaggggacgtttggcaaagttaagtatgccaggaactttgagagcaacgagagttttgcgatcaagattctggacaaggagaagatcttgaagcacaagatggtcgagcagatcaagcgagaaatctccactatgaagctggtgaaacatcccaacgtcatccagctctttgaggtcataggcagcaaaacgaaaatttatatggtgatggagtatgtcacaggtggagaaatgtttgacaaaattgcacgcgagggaaagctagatgaacataaagctcgaaagtatttccagcaattgattgatgccgtggattattgtcacagcagaggtgtttgtcaccgtgacttaaagccggagaatttgctcttggattcagatggaaatctgaaaatctcggacttcggattgagtgctcttcctgagcagtgccgaaaagacggccttcttcatacaacttgtggaacaccgaattatgtagcacccgaggtcgtcagtgacaaaggctacgacggtttcaaagcggatatctggtcttgcggcatcgtcttgtacgttatcctggctggatatttgccatttgacgagcctaatctggttgcattgtacaaaaagatgcatcgag

SEQ ID NO: 6212 - DNA, 675 bp, Artificial
  Synthetic
ttgtgaagcttttggcgcattcccagcggccgggcgagggcatcgtgatctggaaagaatgcgatcctagtgccgggcacagtcgatccatcaatcgacttcggcggcggcggcggggcggcatggtgatgcgcaaggtgggcaagtatgagatcggtcggacgattggcgaaggtacgtttgccaaggtcaagttcgcgcaaaacaccgagaccggggagagcgtcgccatgaaagtgctcaacaaggagacgatcctcaagcacaagatggtcgatcagatcaagcgagagatctctatcatgaaacttgtgcgtcacccttatgttgtccggcttcacgaggttcttgctagcagaaccaaaatctacatcattttggagtttgttaccggtggagagctgtttgacaaaattgtggatcaagggagacttagtgagaatgagtcgcgcaaatactttcagcagctaattgatgctgtggactattgtcacagcaaaggagtttatcaccgagatttgaagcctgaaaatcttctccttgattcgcaaggaaatttgaagatatcagatttcggcttgagtgctctgccgcaacaagaagatggacttcttcatacaacctgtggaactccaaattatgttgctccagaggttcttgataacaagggttatg

SEQ ID NO: 6213 - DNA, 814 bp, Artificial
  Synthetic
cccacgcgtccgctcttgtctctctcggtttcggatccgtcggaagctctttaatccccaacaagtgcttgttaaagcaaaataattgggatgcagaaggatggggttatatagcagcgattaccttttggaggctactaaatttcagtgtgcattgttgttagtcttcctcatccttcgtgatctcaaatatgcagctcacggcacacttaacttctcgtgccagatgcacaatgaagcgacaacccttatacatctcgtcatgctgaagcacagtcttgtcggagacggttgagctccgtaacaaggcctcctgcctgttacaaacgagcatcatcacagcaggagaaagttacttgtagttgttactaggattgtcgattcaaatggaggagaagaaaggaaatgttttgatgcaaaaatatgagttggggagattattaggtcaaggaaattttgctaaggtttattatggaaggaatcttgaaacgggacagagtgtagccatcaaggtaattgataaagagaaggttctcaaggccggactgatcgaacagactaagagagagatatctattatggcactggtcgaacacccaaatgttctacagctatacgaggttatggcaactaaatctaagatttacttagtgattgaacaagccaaaggcggggagcttttcaaaaaattgacaaaggggagactcaaggaaaatgtagctaggaagtactttcaacaattgattagtgctgttgagtgttgccacaaccaagatgtttatcaccgtgatctgaaaccagaaaatgtgctgct

SEQ ID NO: 6214 - DNA, 467 bp, Artificial
  Synthetic
tgcagaggagggaggatcttcttcacagcctttcttagctcacaaggtttttgatttttaggtgaaggaaaaaaagatatagaagtttgcctcgaaaatataccctctacttggaagtgagaaacgcttctcccgctggttctctaagacggcgcaaatgcctgaaagatgctctagcagtagcagtcaaagtgttaaaacaagagttggaaatttcgagctcggccgtgttcttgggcaaggcacctttgccaaggtgaagattgccaaaaatgttgtcaccagccagattgtggcgattaaaatcctcgataaagagagagtgctcaaagacaatctcgttaatcagattaaacgggagatttcgacaatgaagctggtgaagcaccccaacgttgttcaactctatgaggttacagcaagcaaaagcaaaatctattttgtgctagagtatgtcactggaggcg

SEQ ID NO: 6215 - DNA, 465 bp, Artificial
  Synthetic
  misc_feature (106)..(106): The residue at this position can be any nucleotide.
ggcggaggaggagaggggcttcgaactctgtggcgagtcttcggagaagggggagggagaatgagtcttcagagcgtgagcacgcgagtggggaagtacgagctgngaagaacccttggagagggaacatttgcaaaggtcaaattcgccactaataccgattctggtctttccgtcgccatcaaagtccttgataaggataaaatcctcagacacaagatggtcgaacagataaagcgtgaaatttcgacaatgaagctgatcaggcatccaaatgttgtacagttatatgaggttacagctagcaaaacaaaaatctacattgttctggaactcgtcactgggggcgagttgttcgataaaattgttcatcatggaagacttaaggaggatgatgcgaggaggtatttccaacaacttatcaatgcggttgatttttgccatagcagaggagtttgtcacagg

SEQ ID NO: 6216 - DNA, 673 bp, Artificial
  Synthetic
gcggacgcgtgggcggacgcgtgggcgaagaactctgcttcttcaacacagggcttgcctctccttctctctcctccgccatccaaggaccccttcctgtacaagtgaagcgatggcggacggggcagaaacagacaagaacattgagatatggaagatcaagaagctgataaaggctcttgagtctgcccgtggcaatggtaccagcatgatctctctcatcatgccccctcgtgaccagatctcccgtgtggctaagatgctcggcgatgagtatggtactgcctccaacatcaagagcagggtcaacagacaatcggtattgggtgccatcacctctgcccaacaacgtctcaagctctacaacaaggtccccccgaacggtcttgtcctctacacaggtacgattgttacagacgacggcaaggagaagaaggttacaatcgacttcgagcccttcaaacccatcaacgcatctctctatctttgcgacaacaagttccacacggaggccctcaatgagctcctagagtcggacgagaagttagggttcattgttatggacggaaatggaacactttttggaaccttgagtggtaacacccgtgaggtcctccacaagttcacggtcgatctaccaaagaagcacgggagaggagggcaatctgcgctt

SEQ ID NO: 6217 - DNA, 627 bp, Artificial
  Synthetic
cgcacacgaacatcacctcaggcgctcgctcgccgcgccgcggcgcccggccatctcgctcgttcacgcaggcgaagagagctgtaaacactagccaagatgggcgagggacatgaaaccgacaagaacattgaagtatggaaggtcaagaaattgatcaaggcacttgatgctgccaggggcaacggaacgagcatgatttcgcttatcatgccacctcgtgatcaggtctcccgagtcaccaagatgctgggtgatgagtatggaactgcctctaacatcaagagcagagtcaaccgtcagtccgtgttggccgccataacttctgcccaacagaggctgaagctgtatagtcgagttcccgcgaatggattagtgctctatactgggaccattgtcaccgatgacggcaaagagaagaaggtcaccttcgactttgagccgttcaggccgattaacgcttcgctgtatctgtgtgacaacaagttccacacagaggcactgaatgagcttctggagtctgatgacaagtttggtttcataatcatggatggcaacggaacactgtatggtacacttagtggcaacagcagggaggttctttacaagttcagcgtcgatctcccg

SEQ ID NO: 6218 - DNA, 837 bp, Artificial
  Synthetic
cgcgtcgcgaataacaaggatgtggcagaagaatatggtactgcgtccaatattaagagcagagtaaatcgtcagtccgtccttggtgcaataacgtccgcccagcagaggcttaagctgtataataaggtacctcctaatgggttggtcctttatactggaactataatgaccgacgatgggaaggaaaagaaggtaacctttgaccttacaccttttaagccaataaatgcgtctctgtacctatgtgacaacaagtttcacacggagcctctgggcgagctgttggaatcagatgagaagtttggtttcattgtcatggacggtaatggcactcttttcggaaccttaagtggcaacactagggaagtccttcataaattcactgttgaccttcccaagaagcacggaagaggaggtcaatcagctttgcgatttgctcgtcttcgaatggaaaaacggcataactatgtgaggaagacagcagagcttgctactcaattcttcattaatccagccactagccagccaaatgtatccggactaatacttgctgggtcggcggatttcaagaccgagctaagccaatctgatatgtttgatccgcgcctacaagcaaagatacttaacgtggtcgatgtgtcctatggtggggaaaatggcttcaatcaggcaatcgagctatctgctgagattctggctaatgtgaagtttatacaagaaaagcgcttgatagggaaattctttgaggaaatcagtcaagatactggaaagtatgtgttcggtgtggatgacacaataaaaggtttggagatgggagctgttgaaattcttatt

SEQ ID NO: 6219 - DNA, 660 bp, Artificial
  Synthetic
cctctcccattcgtggattggctcttggagaagaagggtttcgaggtttcttggccagtctatattctggcaagcggttgtgaaggtgggcattgctgtctctgaagggtctttacatcatcatcagggtaggtaacaatgtcaggagcagggcaacgtctaaatgtagtcccgacagtaacagttctaggtgtgattaaaactcgtttggtgggtgcaacgaaggggcatcagctactaaagaagaagagcgatgcattaacagtacagttccgtcaaatcctaaggcacatcgtacagactaaagaggccatgggggactctatgaaagccgctgcttttgccctcacagaggccaaatacaccgctggcgacaacatcaaacacgttgtccttgaaaatgttgactccgccacagtcaaagtccggtcaaagcaggacaacgtggcaggagtcaaacttccccgttttgagttcgtgacagaggcaggggagtcaaagaatgatttgactggtcttgctcgaggaggtcagcagatccacctctgtaaatcggcgtttatcaaatcagttgaggttcttgttgagttggcctctctgcagacatcgtttcttacccttgatgtggccattaagaccactaaccggagggtcaacgct

SEQ ID NO: 6220 - DNA, 1096 bp, Artificial
  Synthetic
ggcccacgcgtccgttaaaggcaacgttgatagttgaccccactcccccgcaagcgcctctcccatctgattcgtgtctgaaatcctcgctatctttctctcccattctgacgaattcgacttctaaagtagctaagcaaaatgtccgggcaaagccagcgtttgaatgtcgttcctacagttacaatgcttggtgtgatcaaagctcgccttgttggtgctacaagaggccatgctctgctcaagaagaagagtgatgctttgactgtgcagttccgtcagattctaaaggacattgtgtcaacgaaggaatcaatgggagatgtcatgaaaacttcctccttcgctctgacagaggcaaaatatgcttctggcgagaacattaagcatgttgtccttgaaaatgtccagaatgcaaccatcaaagttcgatctcgccaagacaatattgcgggtgtaaagctccctaaattcgagcatttcgctgaaggagagacaaagaatgacctgactggattagctagaggggggcaacaggtgcaagcttgccgtgctgcttacgtgaaatctattgagttgcttgttgagcttgcctctctacagacatcattcttgacgcttgatgaggcgatcaagaccacaaatcggagggttaatgcattggagaatgttgtgaagccacggttggagaacacagtgctttacatcaaaggagaacttgatgaactggaaagggaagatttctttcgtctaaagaagatacaaggttacaagaagagggaggtagagagacagatgctggcttccaagcaatacgcagaggagaaggctgcagaagaaatttccttgaagagaggtatttcgctaggtacagcccataacttgctatcccatgcttcacagaaagacgaggacattattttctgataaggaggtcaaatgatttatttaaattgcattgcgtggcttgtttttatgtgtcctttattacgaatggataattgattagatggagagtcttttcgcatttaataagagctctatgcatgtttgtatttaaagttaatttatagacaatatgggtggttacctctta

SEQ ID NO: 6221 - DNA, 715 bp, Artificial
  Synthetic
attcgatcttagccccgagaattttgttcttggcacagttgagggaactcttttcttctgctgagatatctgaataatctcctgatctctttcttctccgtgcgaaatctagtttttaagtagcttagcaaaatgtccgggcaaagtcagcgtttgaatgttgtacccacagttacgatgctgggagttattaaagctcgccttgttggagcaacaagaggccatgctttgctgaaaaaaaaaagtgatgctttgactgtgcaattccgtcagattctaaagaatatagtgtcaacaaaggaatcaatgggagaagtcatgaaagattcctcctttgctctgactgaggcaaaatatgctgctggtgagaacatcaagcacgttgtccttgaaaatgtccagaatgcaactcttaaagttcgatctcggcaggaaaatattgctggggtgaagcttcccaagtttgaacatttctctgaaggggagaccaagaatgacctgactggattagctagaggtgggcaacaggtacaagcctgtcgtgctgcttatgtgaaatctattgagttacttgttgagcttgcatcgctgcaaacatcattcttgactcttgatgaggcaatcaagaccacaaatcggagggtcaatgccttggagaatgttgtaaagcctcggctggagaatacagttctttacatcaagggggaacttgatg

SEQ ID NO: 6222 - DNA, 706 bp, Artificial; identical to SEQ ID NO: 5026
  Synthetic

SEQ ID NO: 6223 - DNA, 369 bp, Artificial; identical to SEQ ID NO: 5021
  Synthetic

SEQ ID NO: 6224 - DNA, 992 bp, Artificial
  Synthetic
  misc_feature (194)..(194): The residue at this position can be any nucleotide.
gctgcccaccctggaaacggctcagccggaggtagggtccagcggctggaagagcaccgcacgtcgcgtggtgtccggtgcgcccccggcggcccttgaaaatccggaggaccgagtgccgctcacgcccggtcgtactcataaccgcatcaggtctccaaggtgaacagcctctggtcgatggaacaatgtangcaagggaagtcggcaaaatggatccgtaacttcgggaaaaggattggctctgaaggctgggctcgggggtcccagttccgaacccgtcggctgtcagcggactgctcgagctgcttccgcggcgagagcgggtcgccgcgtgccggccgggggacggactgggaacggctctctcgggagctttccccgggcgtcgaacagtcagctcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttttaacgttattttacttactccgtgaatcggaggcggggtacaacccctgtttttggtcccaaggctcgcttcggcgggtcgatccgggcggaggacattgtcaggtggggagtttggctggggcggcacatctgttaaaagataacccaggtgtcctaagatgagctcaacgagaacagaaatctcgtgtggaac

SEQ ID NO: 6225 - DNA, 806 bp, Artificial
  Synthetic
gggaaccccgacagatagcgcgtttcgcgcgtactccgaaagggaatcgggttaaaattcctgaaccgggacgtggcggttgacggcaacgttaggaagtccggagacgtcggcgggggcctcgggaagagttatcttttctgtttaacagcctgcccaccctggaaacgactcagtcggaggtagggtccagcggctggaagagcaccgcacgtcgcgtggtgtccggtgcgcccccggcggcccttgaaaatccggaggaccgagtgccgtccacgcccggtcgtactcataaccgcatcaggtctccaaggtgaacagcctctggtcgatggaacaatgtaggcaagggaagtcggcaaaatggatccgtaacttcgggaaaaggattggctctgagggctgggcacgggggtcccattcccgaacccgtcggctgtcggtggactgctcgagctgctcccgcggcgagagcgggtcgccgcgtgccggccgggggacggactgggaacggttccttcgggggccttccccgggcgtcgaacagccaactcagaactggtacggacaaggggaatccgactgtttaattaaaacaaagcattgcgatggtccctgcggatgtttacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcga

SEQ ID NO: 6226 - DNA, 1279 bp, Artificial
  Synthetic
gaattcgagaacccaaaacaaaagctgttttctgttctttctgaataaaaatggcaacttgggtcttatcagaatgtggtttaagacctttgcctcgattaataccaaaacccagaacaggattgttatcaaacaatagaagtagtagtgttaagctgcctttgggtgttgttaataaaaagattgaatcagttggttcaagagatcttaatcagatttggttcaatggggcagctgtatccggaaccagaagtaaagattggggattgaaagttagcgtgccattacaggttgcatctttggatggcgaagaggaagaagagaaggtgaatgggtttatgaagaattcggaatttgacccaagtgcaccaccaccatttggattagctgatatcagagctgctattcctaaacattgttgggttaagaatacatggaagtctatgagttatgtacttagagatgttgttattgtctttggtttggctgctgctgctgctgctcttaataattggattgtttggccgctctattgggcggctcagggaactatgttttgggcattatttgttcttggtcatgactgtggtcatggaagcttttctaacaaccacaagttaaatagcgtggtggggcatattcttcactcgtcaattcttgcaccatacaatggatggagaattagtcataggactcaccatcaaaaccacggtcacgtcgagaatgatgaatcatggcacccgttgcctgagaagatctataggagcctaaacgcagctacaaagagtttgcggtttacagtgccttttcccctccttgcatatccattctacttgtggagtagaagtcctggaaagacgggttctcactatgaccctaacagcgatttatttgttccgaatgagagaaaagatattatcacctccacagcgtgttggatagctatggtgggtttgcttgtgggtttatcatgtacaattggtcctatgcaagtgcttaagctctacggggttccctactggatctttgtcatgtggttggatttcgtaacttacttacatcaccatggccatgaggaaaagcttccatggtatcgtggaaaggcatggagttacttaagaggaggcctcacaacaattgatcgtgattatggttggattaacaacatccaccatgacattggaactcacgtgatacatcacctcttcccacaaataccacattacaaccttatagaagcaacagaggcagctaaaccagtgctcgggaagtactaccg

SEQ ID NO: 6227 - DNA, 749 bp, Artificial
  Synthetic
gtttccttctgcattataaaaaatcttggacctaacattgttattctccgctcagaacaggttcagggttgaagactctggacgaaaatcaatggggtctctgggaataagtgagatttatgataagagcagctttaacgagatggagtttgaattcgacccgagtgcccctcctccgttcaggctggccgagatacgaaatgccatccctaaacattgctgggttaaagatccatttaggtccttgagctatgttgtcagggacgttgtatttgttgctaccttgattggtatagcaattcacttggatagttggttgttttacccagtttactgggctgtccaaggcaccatgttttgggcaatctttgttcttggacatgattgtggccatggcagcttttcagacagccagttgctaaataatgtggttggtcacatacttcattctgccattctggtaccctaccatggctggagaatcagccacaaaactcaccatcagaaccatggaaatgtggagactgacgagtcttgggtgccgatgcctgaaaagctatacaaaaaagtgggttattcaaccaagttcctaagatacaagatcccttttcccttgttagcatatccgatgtacctgatgaagagaagtccaggaaaatctggttctcatttcaacccatacagtgatttgttccaaccccatgagaggaagtctgtggttacatcaactctgtgctggactgtcatgg

SEQ ID NO: 6228 - DNA, 481 bp, Artificial
  Synthetic
aagaaaagtaggggataatgctttgatgtatacggagtattcaactaattaaggtgaaggggggaaaacccaacagttcacccaattgatacaatctggttgcaattcggaaatataagatccaattgaagagagtttacaacaacttacaaaaagtgaaggtaaaattatttagccggtgtaaacatggacgccaatggcaaggaggaagatagtgatgaggccaaaataaataatggtatggaccaaaatggaggcgccgctagtttgcatgttcccaaattcaaccacttttccacggccgggaagctggaataataggcccggagttaacagcacaaacagcaccactgctatcaacactgggccccagtccgccattgctccacacgattaacttgtcggtttgagcagatgaaatgaatggaaaatgggggtgactgatgacagcccaagatctagaaaaagtccaaaagtgacg

SEQ ID NO: 6229 - DNA, 608 bp, Artificial
  Synthetic
  misc_feature (255)..(255): The residue at this position can be any nucleotide.
tggaatttgtttggtcttctgatggagaatatgctgtgagagaaagtacttcaaggattaggattttcagcaaaaatttccaggaaaagaagagcatccggcccactttctctgctgagcacatctatgggggtactttattggcaatgtgctcaaacgatttcatttgtttctacgattggactgagtgcaggttgatacgacgaattgatgttaatgtcaaaaacctctattgggctgacagtggtgatctgngtaggctattgacaagtggatttccttcattttttacatacttaaatacaatcgcgatgttgtctctgcacatttagatagtggaagatctggagatgaccaaggtgttgaagaagcttttgaacttctttatgacataaatgaacgggtcagaactggaatttgggttggagattgtttcatttacaataattcttcttcgaggctgaactactgtgtaggcggtgaggttaccacaatgtttcacttagaccgacctatgtatttgctgggatatcttgctaatcaaagcagggttttcctggttgacaaagagttcaatgttgtgggatatactttactgctcagcttga

SEQ ID NO: 6230 - DNA, 606 bp, Artificial
  Synthetic
gtcctactttctcagctgagcgcatctatggaggtactctattggcgatgtgctcaaatgattttatttgtttctatgattgggctgactgtaggttgatacggcgaattgatgttaatgtgaagaacctctactgggctgacagtggtgatatggtggcaattgcaagtgatacatctttctacatacttaagtataatcgtgatgtggtttctgcccatttagatagtggaaggtcagtagatgagcaaggtgttgaagaagcttttgaacttctttatgagataaatgaacgggtcaggactggaatttgggttggcgtttgcttcatttacaataattcttcatggagacttaactactgtgttgggggtgaggtgaccacaatgtttcatttagaccggcctatgtacctgcttggatatctagctaaccagagtagagttttcctgattgacaaagagttcaatgtcattggatatactttactgctcagcttgatcgagtacaagacacttgtgatgcgtgatgactgggacagagcaaatgaggtgctgccattgattcctaaggagcaccataatagtgttgctcgtttcttggagt

SEQ ID NO: 6231 - DNA, 570 bp, Artificial
  Synthetic
ttggcttgattgagtacaagacacttgtgatgcgtggcgactgggatagagcaaatgaggtcttaccatcaattcctaaggagcatcacaacagtgttgcgcgtttcttggaatcacgtggaatgatagaggaagcattagaagttgctactgaccttgactacagatttgaactagccatacagctgggtaaattagatattgcaaaggaaattgccgtagtggcacagagtgagtccaaatggaagcagttgggtgacctagccatgtctagtggaaggcttgagacagcagaggaatgtttgaagcatgcaaatgacttgagtggtttgttgctactctattcttctttaggagatgctgaaggaataactgaactagcatcttttgcaaaagaacacgggaaaaacaatgttgcattcctttgcatgttcctgttgggtaaagtggacgagtgcattcagctgttggttgacagcaatcgggtacctgaggctgcatttatggcacgatcttatctgcctagtaaagtttctgaaatagtatcaatttggagaaaggacctcagta

SEQ ID NO: 6232 - DNA, 396 bp, Artificial
  Synthetic
ttaggaccggtatatgggttggggactgcttcatttacaacaactcttcttggaagcttaactattgtgttggaggcgaggtaaccacaatgtatcatttggaccgcccaatgtatttgttaggctatattgccaaccaaagccgggtttacttggtagacaaagaattcaatgtcataggatataccctgctgcttagcctgattgaatacaagactcttgtgatgcgaggcgatttggatagagccaatcaaattttacctacaattcctaaagagcagcataacaatgttgctcatttcttggaatctcggggaatgattgaagatgctttagaaattgcgacagatccagactacaaatttgatctggccatacaactgggtagacttgaaa

SEQ ID NO: 6233 - DNA, 868 bp, Artificial
  Synthetic
ttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggcccgcacgaagcagacggcgcgcaagtccaccggcgggaaggcgccgaggaagcagctggcgaccaaggcgtgaagaagccccaccgcttcaggcccggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgcgctgcaggaggccgccgaggcgtacctcgtcgggctgttcgaggacaccaacctgtgtgccatccacgccaagcgcgtcaccatcatgcccaaggacatccagctcgcgcgccggatccgcggcgagcgcgctgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataa

SEQ ID NO: 6234 - DNA, 603 bp, Artificial
  Synthetic
ggggaaaatagtactgatatttcattaaaatgcacttcattgaactacatagccagaactgagaaagtactacaccaaaacacaaaaggctcaaaacccttaacaaacaatccactatacacccaaaaactaatttaagctctctcgcccctaattcttctggcaagctgaatgtctttaggcataatggtaaccctcttagcgtggatagcacaaaggttagtgtcctcaaacaaaccaacaaggtatgcttcagccgcctcttgaagagctgcaacagcagagctctggaacctcagatcggtcttaaaatcctgagctatctcacgaaccaaacgctggaacggaagtttacggatcaggagctcagttgatttctggtactttctgatttcacgaagcgcaacagttccaggcctgaatctgtgtggcttcttcactccaccggtcgccggagctgatttccgagcagcttttgtggcgagttgcttccttggtgctttgccaccagtggacttacgagcagtttgcttggtacgtgccattgagaaaattgaaaaattcagagaactttcggacttgtagggttttctgctttgaaat

SEQ ID NO: 6235 - DNA, 688 bp, Artificial
  Synthetic
agtaaaacaccacatcccaagtcaatacacattaacccagccatacaaacgactccaaaacaccaaccaaaatcacaactttcacagcattctcgaccttctcccctcttgcaaaaaatcctttaaaaatggcaagaacaaaacaaacagcacgtaaatccactggaggaaaggcaccaaggaagcaactcgcaacaaaagctgcaagaaaatcagctccggcaaccggaggagtgaagaagccccaccgtttccgtccaggtacggtggcacttcgagagatccgtaagtatcagaagagtactgaacttttgatccgtaagctcccttttcagagactggtaagagaaatagcgcaggattttaagactgatttgaggttccagagcagtgctgtggcggcgcttcaggaagcagcagaggcgtacttggtgggtttgtttgaagataccaacttgtgtgctatccatgctaagagggttaccattatgcctaaggatattcagttggctaggcggattagaggtgaaagggcttagtgtacttttgtttgcaattggatttagtttttaggttgtctttttgttgtaatgtaatgaactatttgataaagaaaatctggaaaagattgctggttgatggtaaagtgttaatttcttcagctaattatttaatcttaccttatttt

SEQ ID NO: 6236 - DNA, 684 bp, Artificial
  Synthetic
gccagtttggtcgctctcgatttcgatttcccccaaatccaccgcaagagaaagccaagtcgccgccgagaagcgaagaggagatggcccgtacgaagcagaccgcccgcaagtccaccggcggcaaggccccgaggaagcagctcgccaccaaggcggcgaggaagtctgctccgaccaccggcggcgtgaagaagccccaccgctacaggccggggacggtggcgctccgcgagatccgcaagtaccagaagagcacggagctcctgatccgcaagctccccttccagcgcctcgtccgcgagatcgcgcaggacttcaagaccgacctccgcttccagagccacgcggtgctcgccctccaggaggccgccgaggcctacctcgtcgggctcttcgaggacaccaacctctgcgccatccacgccaagcgtgtcaccatcatgcccaaggacatccagctcgcccgccgcatccgcggcgagcgcgcgtaagccgccgccttcgacgcggttgcgttgcgtagcgccgaagcgatctggggggatcaacgacgacgacgtgacgtggtcaacttgttgattcccctctcgcttccgcgttttagatctcgttttcattagcagctttgtaatagggtttggtcggttaattagtgtaaaaacagggttcggttaaagactc

SEQ ID NO: 6237 - DNA, 713 bp, Artificial
  Synthetic
gttcgcgtgggaaagagagaaaaagaacaagatttcataggaaatggctcgtaccaagcaaactgctcgtaagtctacaggaggaaaagctccaaggaagcaacttgctactaaggctgcacgcaagtctgctcctaccactggtggtgtgaagaagccacatagataccgccctggtactgttgctcttcgtgaaatccgtaagtaccagaagagtactgagctcttgatcaggaagcttcctttccagaggcttgtgcgtgaaattgcccaggactttaagactgatctgcgtttccagagtcatgcagtgctggctctgcaggaggctgctgaggcctatctggtgggtctctttgaggacactaacctttgtgccattcacgccaagcgtgtgacaattatgcctaaggacattcagcttgccaggcgaatcaggggcgagcgtgcttaatttgatctactagcttgtagcgttggtgtgatccttgtctttcttttctttgtaagacgtaaagacagtaactaaatctagtagtagggcttgttgcttttaatttgctggtggctggtggtgtgctgtaatttcttggtgttttcttttggagaagggggaaaacatgctattttgtttggatctctaatgttttgttgtcacactactggtgtcgaacaatgttttcatctagtgattagttgaagttattgtcgat

SEQ ID NO: 6238 - DNA, 639 bp, Artificial
  Synthetic
ggacaatcaaagcattctccaatctacataatggcccgtactaagcaaacagctcggaaatcaacaggtgggaaggctccaaggaagcagctagccactaaggctgcgagaaagtcagctccggcgaccggaggagtgaagaagcctcaccgtttccgtcccggaaccgtggctttgagggaaatcaggaagtaccagaaatcaacagagttgttgataaggaagttgccgtttcagaggctagtgagggaaatagcacaggatttcaaaacagatctgaggttccaaagcagtgctgttgctgccctacaagaggctgctgaggcttaccttgttggcctctttgaagatacaaatctctgtgccattcacgccaagagggtcactatcatgcccaaggacattcagctcgctaggaggattcgtggtgaaagggcttaggatgaagcttgtttatgcttatgtttatggttaattcgtgttctctgatctagggcattgcttttgtgtctttttgctgaatgttagggttagtgatgttaatcaattgacttgtttcagtcaaagtatatgtaaaatctctggtttattagtattttgaaatcttattaatgagatttgtcattcattttgctgttc

SEQ ID NO: 6239 - DNA, 625 bp, Artificial
  Synthetic
cccaatctataaaacctttcatattcaaaatggctcgtactgagcaaacagctcgcaaatcaacaggtggaaaggctccaaggaagcagctagctaccaaggcagcgagaaagtcagctccggcgaccggaggagtgaagaagcctcaccgtttccgtccgggaactgtggctttgagagaaatcaggaagtatcagaaatcaacagagttgttgataaggaagttgcctttccagaggctagttagggaaatagcacaggatttcaagacagatctgaggtttcagagcagtgctgttgctgccctgcaagaggctgctgaggcttaccttgttggactctttgaagatacaaatctctgtgccattcacgccaagagggtcactatcatgccaaaggatattcagcttgctaggaggattcgtggtgaaagggcttagaatgaagcttgttatgcttatggttatggttaattgtcttctctgatcttgggcatcgttttagtgtcttttgctgaatattagggttagcgatgtaaatcaagtgacttgtttcaatcaaagtatatgtaaaacctctaattagtactttgaattcttattaatgaaatttgtcgttcattttg

SEQ ID NO: 6240 - DNA, 607 bp, Artificial
  Synthetic
cccacgcgtccgcaaatccaaagaaatcactcgccgccgccgcctcgccttctccgccgcgccaagctctcctctcctcctcctcgatggcccgcacgaagcagacggcgcgcaagtccaccggcgggaaggcgccgaggaagcagctggcgaccaaggcggcgcgcaagtcggccccggccaccggcggcgtgaagaagccccaccgcttcaggcccggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgcgctgcaggaggccgccgaggcgtacctcgtcgggctgttcgaggacaccaacctgtgtgccatccacgccaagcgcgtcaccatcatgcccaaggacatccagctcgcgcgccggatccgcggcgagcgcgcttaggcgatccgccctcctttggttcttgcttggttcgtagggacttgtcatgttctaccagttcttgttaattattagatccttgccttgtcatgtcgtagtctttgattctt

SEQ ID NO: 6241 - DNA, 718 bp, Artificial
  Synthetic
cccccccactgttcgcctttccacgccagtttggtcgctctcgatttcgatttcccccaaatccaccgcaagagccaagtcgccgccgagaagcgaagaggagatggcccgtacgaagcagaccgcccgcaagtccaccggcggcaaggccccgaggaagcagctcgccaccaaggcggcgaggaagtctgctccgaccaccggcggcgtgaagaagccccaccgctacaggccggggacggtggcgctccgcgagatccgcaagtaccagaagagcacggagctcctgatccgcaagctccccttccagcgcctcgtccgcgagatcgcgcaggacttcaagaccgacctccgcttccagagccacgcggtgctcgccctccaggaggccgccgaggcctacctcgtcggtctcttcgaggacaccaacctctgcgccatccacgccaagcgcgtcaccatcatgcccaaggacatccagctcgcccgccgcatccgcggcgagcgcgcgtaagccgccgccttcgacgcggttgcgttgcgtagcgccgaagcgatctggggggatcaacgacgacgacgtgacgtggtcaacttgttgattcccctctcgcttccgcgttttagatctcgttttcattagcagctttgtaatagggtttggtcggttaattagtgtaaaaacagggttcggttaaagactcaaaatcaaatgtta

SEQ ID NO: 6242 - DNA, 673 bp, Artificial
  Synthetic
accacgcgtcgctttttcttctatctttgccatcctcgttctggttttggtagacagacaagaatggctcggacaaagcagaccgctcgtaagtcgaccggggggaaggcgccccggaagcagttggccaccaaggcagctcgcaagagtgcccctgccacaggtggagtgaagaagccccacaggttcaggcctggaactgttgcccttcgtgagattcgcaaataccagaagagtactgatctcttgatccgaaagctccccttccaacgcttggttcgtgagatagctcaagacttcaagactgatctccgattccaaagctctgctgtcttggccctgcaggaggctgctgaagcatacctagtgggtctctttgaagacacaaatctctgcgctattcacgccaagagagtgacaatcatgcctaaggatattcagctggccaggagaatcaggggggagcgtgcctaagtaaatattcctgaccttaccttcttaacggtgtatttgtacaccacattttgcctttgaaagttacattttggtctagtaatctatttctctgtttcagtgggcattactagtgatgcctaggctgatgggatgatcacttagtgatgataaccttggtacattttgattcatgttgtaagtttagagcatccgattt

SEQ ID NO: 6243 - DNA, 656 bp, Artificial
  Synthetic
ataattttggcggggtttggaactgcgatttggaattcctcctgcacttcgacgacttctgatttcctgcgatggctcgtaccaagcagacagctcgtaagtctactggtggaaaggcacccaggaagcagcttgctactaaggctgcaaggaaatctgctcccactactggcggagtaaagaagccccacagatacaggcctggaactgttgctcttagagagatccgcaagtaccagaaaagcacagagttgctgattaggaagcttcctttccagaggcttgttcgtgagattgcccaagattttaagactgatttgcggtttcaaagccatgctgtgctggcattgcaagaggcagcagaggcatacctggttggactcttcgaggacaccaacctctgtgccatccatgcgaagagggtcaccattatgcctaaagatatccagcttgccaggaggatccgtggggagagagcttaacccgtcttttgctgaaagaactgtagttattttagttatttaattgttgtcatcttgtcttgtgctcgaagtaactgccttgttactttgctgttgggctcgttcccaagaaacttgtggtcttattggccaattgtactagcttaatatacactgcttgtttttgaacaatgt

SEQ ID NO: 6244 - DNA, 585 bp, Artificial
  Synthetic
acttgacttagggttcttcgcgctagggttcttcgatcgtcttctcttcgaaccggccatggcgcgtaccaagcagaccgctcgcaaatccacgggaggcaaggcgcccaggaagcagctcgcaaccaaggctgccaggaaatccgctcccaccaccggaggagtgaagaagccccatcgctaccgcccaggaacagtcgctcttcgtgaaattcgcaagtaccagaagagcactgagctcctcatccgaaagcttcccttccagaggcttgttcgcgagatcgctcaggacttcaagaccgatttgaggttccagagccatgcggtgctggccctccaggaggcggcggaggcgtacctggtgggactgttcgaggacaccaatctgtgcgcgattcatgccaagagggtgaccatcatgcccaaggacatccaattggctcgccggatccgtggagagagggcttaagagattcatcaatcttaagaaaactagcttcaccaatgtagatactactactactactactaatccctctgtttgatttgatttcagtgcaaatgcaaagtcttctggttgtttgt

SEQ ID NO: 6245 - DNA, 690 bp, Artificial
  Synthetic
gcggacgcgtgggtggagaggggaaagatttcgtcgcgctagggttttctgattcgtcgtccatggcgcgtactaagcagactgctcgcaaatccacgggaggcaaggcgccgaggaagcagctcgcgaccaaggccgccaggaagtcggctcccaccaccggtggagtgaaaaagccccatcgctaccgcccgggaacagtcgctcttcgtgaaatccgcaagtaccagaagagtaccgagctgctcatccgcaagctgcccttccagaggcttgtgcgtgagattgctcaggacttcaagacggatctgaggttccagagccacgcggtgctggcgctgcaggaggcggcggaggcatacctggtgggtcttttcgaggacacgaacttgtgcgcgatccatgccaagcgggtgaccatcatgcccaaggacatccagttggctcgccgcattcgtggagagagggcgtaagccacagggtgctattcatgacccgttcgctgctactgatgaaggacatagaaaagtcttagaaggatcactttgttttgtaatatactattagaacagcaattcaagttgcttttgctgtgatttagtcaaataaatttcgtggtgtatgattgcattagctcaatcgttatatttgtcacactactaaacttctatttaatccaagttcacaccc

SEQ ID NO: 6246 - DNA, 710 bp, Artificial
  Synthetic
ccccccgaatttttctgcggtttcttcttcttcttcctcctcctcgcgctcccccgattcgaagcgtgaagagaggaacggcgcttgcgagaggagagagatggcccgtaccaagcagaccgctcgtaagtccacaggaggaaaggctcccaggaagcagcttgccaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgccattcatgccaagcgtgtgaccatcatgcctaaggacattcagctggctaggaggattcgtggtgagagggcttaaattcccctcggcgattcctttgacaaatgaagcatgcgtcgtagtgttagtagtgggttttaatcttttgcttataagaacaatctgagtagggtgtattttgtggaacaatatgtttctcatgatggtgctgtattcgtcttattggtggatctgtcaaaaatactcagcatattgtcagtgtgtctggtgactctta

SEQ ID NO: 6247 - DNA, 622 bp, Artificial
  Synthetic
ctacatttacaccatctagtaatcttgttaagcatctcccatacgctgtcaacaatggcatcatacaagatcttggttgtctttgctttgctagctctttctgcaagtgcagctaccgcaatcaccaccactataccatacttcccatcaacactagcaatgggcaccatgaatccctgtaagctgtacatgatgcaaactttgggcatgggtagctacgcaaccatgttcatgtcacaaccaattgctctcctgcaacaacaatgttgcatgcaactacaaggcatgataccacaagtgcctttgtggtgctagttgtcaaatgatgcagaacatgcaaaatgctatttgtggtggactcgggcaacaacaaatgatgatgaagatggtgatgcaactgccatatgtgtgcaacatggcacccgccaactttcaaactctttccttatggttgttgttgatcgaatttcaattactttgtatagtcaaataacaagtgtatgatgcatactatcgtgtgcatctcacactggtggagaaaccgtttgtagtcccggttgataacccccctttagtcccggtttccaaccgggactacgaatccgggactaaagatcgctat

SEQ ID NO: 6248 - DNA, 1554 bp, Artificial
  Synthetic
gaactgatgtgagagatgtagaagttttgagtgagatttatatctctatcaatgacaattacgaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgtgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttaattaagcatggagaaggcgatcaacaggcagagggtgcttctcgcccacctggagcccgccgcgagtcccgccgccgccgcgccggccatcaccgcgagcgcgtgcgccgcgggggacagcgccgcgtaccaccgcggggcgtgcttcgcagacgacgtcgtcatcgtcgctgcctataggacagcaatttgcaagtccaagagaggtggtttcaaggatactcccgcagaggacctcttggttccagtattcaaggctttgatagataaaacgaagttgaacccaagtgaagttggtgatattgttgttggtactgttttagctcctgggtcccaaagggcaattgaatgcagaatggctgcattttatgctggattccctgataccgttcctcttatgactgtaaacaggcaatgttcgtctgggcttcaagcagttgcaaatgttgcttctaacattaaagcaggactttatgacattggtattgctgctggcctagagtccatgacagtgaaccaagttcgccttgatgggcaagtgaaccccaaagttgagctgttttctcaagcacgcgattgccttctcccaatgggcctcacgtccgagaa

SEQ ID NO: 6249 - DNA, 524 bp, Artificial
  Synthetic
ccccccacccaactactaacaggcagctgccagccatggcttcctccccgccgtttcgtctacctctcgccgttgtgctcctactcgcaataatatgtgtccttttggcttctcctagctgccatgcggacgatctccccgccaccatgacaaacgagcacgagaaagagcatcagctgatgatgatgatgatggacaggttccataggtggatggcgacgcacaaccggtcgtacgcctccgccgacgagaagctgcggcgattcgaggtataccggagcaacatggagttcatcgaggcgaccaaccggaacgggagcctcaccttcaagctcggtgaaacgccgtgcaccgacctcacccacgaggagttcctcgcgacctacaccggcgacgtacgccttccgccggagcggcgggggatgcaagacgactccgacgaggaggatgcagtgattacaaccagtgctgggtacgtcgccggcgccggcgccggtaggcgtacggctggggtgccggagtcc

SEQ ID NO: 6250 - DNA, 702 bp, Artificial
  Synthetic
ccccccccggtggtctctcagaggtgggttggcttctcctccccctcccggttcggttcgggtccggttcgatttcggttttttcttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgttaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcggcagctacggtggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactatctagtttgt

SEQ ID NO: 6251 - DNA, 596 bp, Artificial
  Synthetic
aatcccttaaaccctagtgcagcagcggccatggcgatgtcttcgtcgctcggcagcgccctgaggaaggccgcaagcaagggatccttggtgccgcgcggtaccctcgccgtggccgccgcagtgcccgccattcagctgctgagccgctgtttctcgaccaagcttttcatcggcggccttgcttggggcgtggatgatggtagcttgaggagctcattcgctaactatggagaagtcactgaagcgagagttataatggatcgtgagactggaaggtcgaggggattcggctttgtgacctttgagaatgatagcgaagcgaaagcagcggtgcaaggaatggacggaaaggagcttggtggccgcagcatccgcgtggactacgcctcagaccggccagcggcaccaaggcaagactttggtggcggtggcggctacggcggcggcggtgggagctatggcggtggcggtggcggctacggcggcggtggtgggagctatggcggtgatggcggtggcggtggctattgagtgatcgaagatcaaagaagatacaggacttttgcagtgtctgtttaacataagaaaggggg

SEQ ID NO: 6252 - DNA, 553 bp, Artificial; identical to SEQ ID NO: 4768
  Synthetic

SEQ ID NO: 6253 - DNA, 543 bp, Artificial; identical to SEQ ID NO: 4792
  Synthetic
  misc_feature (529)..(529): The residue at this position can be any nucleotide.
  misc_feature (531)..(531): The residue at this position can be any nucleotide.

SEQ ID NO: 6254 - DNA, 595 bp, Artificial
  Synthetic
cccccccccgaaaaccctcaggtcggcctccctcctctcctcgtccctcctccccgccgccgccgcagcagatttaatcctcaatggcggccttcaacaagctcggtagcttcctcaggcacagtggcttgacaagcagtgcctcggccggctcttcccctgccatgtacaatgctgctcgtctgatgtccaccaagcttttcgttggtggtctttcttggaatactaatgacgattcgctgaaagaggcattcaccagcttcggggatgtgactgaagctcgggtgatcaatgacagagaatctggaaggtcaagagggtttggctttgttagctttgccaatggcgatgatgccaagagtgccatggatgccatggacggtaaggaacttgagggacggagtatccgcgtgaacttcgcgaatgagagacctccagggaaccgaggtggcggcgggtatggtggtggtggcggtggttatggcaaccaaggaggctatggtgatggcaaccgaggctatggagggcagtactaaagtgggcactgacttgcttaaataatgagcttaggacctgatgtggcttatgtgaagcc

SEQ ID NO: 6255 - DNA, 706 bp, Artificial; identical to SEQ ID NO: 4784
  Synthetic

SEQ ID NO: 6256 - DNA, 652 bp, Artificial
  Synthetic
ttcattccagcaaagggttaaaagtatggcctttttaatagagttgggagtattcttaaacatagtgtaagcaaacactcaaacttggaactctctgcctcaaatgcgtcacttttccaggctataagaagcatgtcttcctctaagcaaatgaatggggtctctcgtatggcactgatgagagctccctgaaggaggcgttttcccaatacggtgaattgatcgaagctagagttattatggatcgtgatactgggaggtccagaggctttggttttatcagttttccatcaagtgaagaagcagcaagtgcattgcaggccatggatggccaggatcttcatggaagacggataagagtgaattatgcaacagaaaagcgtcgtgctggatttggaggtggctttaactatggtggtgaaggtggaaattttgcaggtggtggaggttatgcagccagcaattatggaggcggaggaggtggttatggtaacagtagtggctttaactatggtggggaaggtggaaattctgcaggtgctggaggttacccaaccagtaattacggtggtggattttctggtggtaacagttctactggtggatatggtagttatggaggtggcagtgactatggaaatgacaacagttc

SEQ ID NO: 6257 - DNA, 705 bp, Artificial; identical to SEQ ID NO: 4780
  Synthetic

SEQ ID NO: 6258 - DNA, 647 bp, Artificial
  Synthetic
aggttaaagatggcttttttagtagagtcgggagtattcttaaacatagtgtaagcaaacactcaaacttggaagtctctgcctcaaatgcgtcacttttccaggctataagaagcatgtcttcgtctaagctttttgttgggggtctctcgtatggcactgatgagagctctctgaaggaggcattttcccaatatggtgatgtgatcgaagctaaagttattatggatcgtgatactgggaggtccagaggttttggttttatcagttttccatcaagtgaagaagcagcaagtgcattgcaggccatggatggccaggatcttcacggaagacggataagggtgaattatgcaacagaaaagcgtcgtgctggatttggaggtggctacggtggaggtggtggtggctttaactacggtggtgaaggtggaaattttgcaggtggtggaggttatgcagccagcaattatggacgcggaggtggctatggtaacagtagtggctttaattatggtggggaaggtggaaattctgcaggtgctggaggttacccaaccaacaattacggtggtggattttctgctggaacacttctgctggtggatacggtagctatggaggtggcagtaactatggaaatgaca

SEQ ID NO: 6259 - DNA, 647 bp, Artificial
  Synthetic
gctgctccttctcagttccggttcgtttcttggtctgttttttgtgttctgatactgcaatggccgctgccgtagagtatcgctgcttcgtcggaggtctgtcatggggcacagacgaccgcgccctcgagcgcgccttcagcacctttggggaggtcatcgattcgaaggttgttaacgatcgtgaatcggggagatctcgtggtttcggattcgtgacattcactcaagaacagtctatgcttgacgcgattgaggggatgaacgggaaagagctcgacgggaggaacatcactgtgaatcaagcacaagaacggaactccggaggtggtggaggcgggtttcgaaggtccgaaggccgttacggcgggggcgggggcggatacggcgggggcggttacagatccggcggtggaggcagtggcggatacggcggaggcagcggtggctatggcggtggtggccaaagaagggactccggcggctacaacggcggaggtggtggtggctatggcggtggaggccgctacgagtgagaacggataccagtcgggattcgaactaccggcctcgctgccagtgggaaattaactctgtcgggtctcgaactcccgaccggtttctttttcctgcctttttctttggac

SEQ ID NO: 6260 - DNA, 629 bp, Artificial
  Synthetic
gggaggagactcctccgacattttcccctttgttctggttcgtttttctctgtttggtttctctgttcggggttcggaaacatggggtctgagtaccgttgcttcgtcgggggtctggcttggtccactaatgaccaggctttggaatccgctttcagtcaattcggaactgtcatcgaatcgaaggttatcaatgaccgtgagactggaaggtctcgtggattcgggtttgttacattcgaggatgagcaagccatgagggatgcaattgaagggatgaatggaaaggatctagatggcaggaacattactgtaaatcaggctcaggacaggtcatcaagtggtggtggtggtggcggctaccgaggaggtggtggtggcggtggaggttaccgtggtggtggtggtggttacggtggcggtggcagtggataccgctcaggtggtggtggatatggtggtggcggccaacgtagggattctgggtacggtggagaaggtggtggctactctggcggtgggggctacggtggtggtggtggtggatacggtggaagtggtggtggtggtggtaacaacaggtggagggacaattaaccaacctatcaaaggatgtgtaactagctatt

SEQ ID NO: 6261 - DNA, 712 bp, Artificial
  Synthetic
tggtatcaacgcagagtggccattacggccgggggttttggttttgtgacaatgtcctccaaagaggaagttgaagctgcctgtcaacaatttaatggatatgaacttgacgggagggaactaagggtgaattctgggccaccaccagagaagagggagaattcttctttccgtggaggcaacaggggtggcggaagttttgatagctccaatagagtctatgtaggaaacctctcatggggtgttgaccaagacgcacttgagaccttattcagtgagcaaggtaaggttgtggatgccaaagtagtctatgatagagatagcggtagatcaaggggcttcggatttgtaacatacagttccgctgaggaggtcaacaatgcaattgaaagcttggacggagttgacctcaatggcagggccatccgtgtaagccttgctgaagctcggccacccaggcgtcaattctgaaggttgtaatcaacatctttttgacagagaaaacgcttgggggtccaggagatgacaatagttgcaacaatgatgagttggtaaatctgcaacttctaccccaaacttgcgcggacgaaacactctctgcttctggactaactagagttctcaagtaaattagctttcgtaatgtatgttctgaaattgccccgggaaaaattcttgatcttgtaatatgctatccatcccttgttgaagg

SEQ ID NO: 6262 - DNA, 483 bp, Artificial
  Synthetic
gggtgttgttgtttagttcgggtttcctgtttcgttctttgtgggccgtggatctagcggaagacaccccgccgttctcgagcttcgaacagccgacgttgcctagctgggatacatggcggcagtggagtattcctgtttcgtcggaggcctggcatgggccaccgacgaccgcagcctcgagaccgccttccgccccttcggaaatgtcacagactccaagattatcaatgatcgtgaaactggaaggtctcgtggctttgggtttgttaccttctctgaggagcaatccatgctggatgcgatagagggtatgaatgggaaggagctcgatggaagaaacattactgtaaaccaagctcagagccgtggttctggaggtggaggtggtggtggcggtggtggattccgcagatctgaaggtggccgatcaggaggaggagggggatatggaggaggagggtatggaggaggaggagggta

SEQ ID NO: 6263 - DNA, 620 bp, Artificial; identical to SEQ ID NO: 4797
  Synthetic

SEQ ID NO: 6264 - DNA, 696 bp, Artificial; identical to SEQ ID NO: 4798
  Synthetic

SEQ ID NO: 6265 - DNA, 660 bp, Artificial; identical to SEQ ID NO: 4774
  Synthetic

SEQ ID NO: 6266 - DNA, 486 bp, Artificial
  Synthetic
gctcccgcgtttcgatccggtatctggttccgtagttctaagttctgtagtttagttgtaagtagtattttctaggtctagagttcgaggatggctggcggcgtcgagtaccgttgctttgttggaggcctttcttggaacactgatgaccgaagccttgagactgcctttagctcttacggcgaggttatcgactccaagatcataaacgaccgggaaaccggtaggtctcgtggttttggctttgtgacattcgccttggagcaatccatgttcgatgccatcgaggggatgaacgggaaggagcttgacggccgaagcattacagtgaaccaggcccaggatcgttccagtggaggtggcggtggcggcggcggtgggggttacagatcagggcgttctggtggaggtggaggagggtatgatggtgagcgaacaagctatggcggagggggccggtctggtggcggcggtgggtatggtggt

SEQ ID NO: 6267 - DNA, 696 bp, Artificial
  Synthetic
ttcttcttctttcgaggggacggcacaatagtgtaaagcccagtagcatcttcttcaatggcgctagcttctcggttcggttcgctcctccgtcgtctgggggcaccgtcctctgcttcgaaccagggatcagcagcacttgcggtaacctctcctttctcgcaggtcctctccaggggtttctgcgatgcggccgatgcctcccccaagcttttcattggcggactgccatggattactgatgattcttctttgagggatgccttttcctcttttggtgttgttactgatgcccgtgttataacagatcgtgagactggcagatctaggggttttggatttgttaccttctctactacttctgaggctgagagtgcccttaactcaatgaatggccgggatctgaatgggagagcaatcagagtcaactttgcaacagaaaggccgtctggtggtatgggtatgggcaggtttggaggtggatgggggggctctggtggaggcggcggcggttttggtggagggaatcgcgacggcggtggttttggtggcggtggtggtggcggtggttttggtagtggtagtggtggttatggtggtggtgatgacctcagatagaaatgagtacattaatatagactgagagattggatctttttataagaagagagtgctttggtgcaaaacatgaatgac

SEQ ID NO: 6268 - DNA, 288 bp, Artificial; identical to SEQ ID NO: 4803
  Synthetic
  misc_feature (192)..(192): The residue at this position can be any nucleotide.

SEQ ID NO: 6269 - DNA, 972 bp, Artificial
  Synthetic
  misc_feature (896)..(896): The residue at this position can be any nucleotide.
aatatcttctctactcaataataataatcatgggttttagctggctctctttctccttgagtttccttctggtgttgcacggtacctttgctcagcagagataccaacagcagcaaggcgagtgccaactccatagacttagccctcaggaacccaccgtccgcattcaagccgaagctggagtcactgagttatgggatccaaataaccagcagttccaatgtgctggtgtctccctaattcgccacgtcatccagtctaggggaatgctgttgccttcctatgttaacacacccctacttgcctatgttgaacgaggtcagggattttatggcatcatgcaatctggatgcccggaaacattccagtcatcccagcaattgcagcaaggtgaaaggggtgccggttcaagatttcaagatcgccaccagaggattggacagtttaggcagggtgacattattgccttccctgctggagctgctcactgggtttataacgaaggaaatgaggagcttgttcttgttgttcttgaagatagcagtaacaatgccaaccagcttggtcgaacttcaaggaggttcttcatagctggaaacccacaacaaggacagcaacaacagcaacaaggacaatacggtggccgcagcttgcgcagggaacaattccaatctggaaatgttttcaatggctttgacgtacaggtcttggctgaggcatttggcgtagaccaggagacagccaggagacttcagggacaggaagaccagagaggccacattgtaaacattcagaaaggactcagagttgtgaggccaccattctcacaggaacaagaggagcgcgaggagagacaagagcaaggacaatacggtcctcgcatgaacggaattgangaaaccatctgctccgctaaagtcaggcagaacattgacaacccctcacgtgctgatatctacaacccacatgccg

SEQ ID NO: 6270 - DNA, 849 bp, Artificial
  Synthetic
atctctcctaattagccatggcagtcactactagactcctcttagctttactcctctctgcttttctcttgtctgcaacaaatgcagtcagagattttcagggtcggcaagctggccagcggggtgagagaggcactcgtctgactgaagctcaacaatgccgtttaacaaggctcactgccactcagcccactaaccgaattgagtccgagggcggtgtcactgagctgtgggacgagaacgaggaacaattccagtgcgctggagttgctcccataaggagtgtcatccgccgcaactccctttctctgcctaatttccatcccatgccgcgcttagtttacattgagcgtggccagggaatgattggcattacttaccctggctgtgctgagactttccagtctcagtcccagaccttccaggctggccgagagccatgggaagagaggggccaaggccgcagaagtgaccaacaccagaaggttcaccgcattcgtcaaggtgatgtcgtggcacttccagctggcgcagctcattggtgctataatgatggtgaggaagagcttgttgccatctctgtcaacgacctcaaccatcgctccaaccaacttgatcagaacttgagggcattctacttggctggtggagtaccagaaagtggaaggcaacaaactcaagcaggccaaagactacagagtaggcagcggttccagaacattttccgtgctttcgatacagaactaatggctgaggccttcaacatccctgccgagattgtaaggaggatgcaagaagagcagagcgaacgtggcctaattgtcaatgtgagggaagaaatgagaatga

SEQ ID NO: 6271 - DNA, 1016 bp, Artificial
  Synthetic
gggcggacgcgtgggaattagccatggcggtcactactagactcctcttagctttactcctctctgcttttctcttgtctgcaacaaatgcagttagagactatcagggccagcaaggccgtcaggagggtctgagaggcactcgtctcactgtagctcaacaatgccgtttaacaaggctcactgctagccaacccactaaccgaattgagtcagagggcggcgtcactgaactgtgggatgagaatgaggagcaattccagtgcgctggagttgctcccatgaggaatgtcatccgtcgcaactctctttctcttcccaatttccatcccatgcctcgcttggtttacattgagcgcggccagggattgattggcattacttaccctggctgtgctgagactttccagtctcagtcccagaccttccaggctggccgagagccaagggaagagaggggccaaggccgcagaagtgaccaacaccagaagatccaccgcattcgtcaaggagatgtcgtggcacttccagctggcgctgctcattggtgctataatgatggtgaggaagagcttgtcgccgtctctatcaacgacctcaaccaccggtccaaccagcttgatcagaacttgagggcattctacttggctggtggagtaccagaaagtggaaggcaacaaacccaagcaggtcaaagactacagagcaggcagaggttccagaacattttccgtgctttcgacacagaactgatggctgaggccttcaacataccagccgagattgtaaggaggatgcaagaaggtcagagcgagcgtgggctaattgtgaatgtgagggaaggaatgacaatgattaggcccgacgaagaagaaggagaattcgaagaagagcaagggcgaccacgacgaggacagcaatggtgggaggaagcaaccggaaatgggttggaagaaaacatttgcacaatgaaaatccgcaccaaccttgaacaccgaacacaagctgatatcttc

SEQ ID NO: 6272 - DNA, 750 bp, Artificial
  Synthetic
gggaaaaatggcttctaactcctctctcatttgttttagcctttgtttcctctttctttttcatggtacttttgctcagatctttgagcaccagcaagtttggcagaggatgcaacagcagcagcaacatcgggcgctcaggtccagaactgagtgtcggatcgagcgcctgaatgctcaagagcctactcgtaggtttgagtctgaggctggtgtcaccgagttctgggatcacactcaggaacaatttgagtgcgccggagtccaagcagttaggcatgaaatccgacgaaatgggcttttgttgccttactacagcaacactccccagctcatctatataattcaaggaaatggagtgcattcggctgtgttcccgggttgtgctgagacattcgagacagagtcagcacaatcgaggaggggagaaaggggagaaagaggagaagcaggacaaagattcaatgaccgtcaccagaaagttagacgttttagagctggtgatattcttgctttgcctgctggtgttacacactggacttacaatgatggtgaagaaccaattatcagtgtctctcttattgacacttctaaccaggccaatcaacttgatctcaccttcaggaaatttttccttgctggaaatcctcaacgtggtgtacaacaacaaatgttaggaaggcaacaggagggagctcctggcctaggaagaagaggtagtgaacaagagagaggaagcaacatcttgag

SEQ ID NO: 6273 - DNA, 842 bp, Artificial
  Synthetic
caaacaatggctactttctcctcagtcctctctctcagcctttgcttcctcgttctctcccacagctgttttgctcagctcttagagcaacagcaacagaacgtatggcagagacttcaacagcagcaacaacaccgcgctctcaggtcaaaaaccgagtgccaaattgagcgtttgaacgctcaagaaccaacccggagatttgagtctgaggccggtgttattgagttctgggatgctacccaagagcagtttgagtgtgccggagttcaagccgttcgccatcaaattaggcgaaatggacttttgcttccttactataccaacactcctctgctcatgtacattattcaaggacgcggtattcactcgactgtgataccgggatgtgctgagacatacgaaacagaatctggagaatccagaaccggagaaagacgccggagtttcaatgataggcaccagaaactcagacgtttcagagccggtgatgttcttgctttgccggcgggagtcactttctggatgtacaatgatgctgaggaaccaattgtcactgtctcacttcttgacacttctaaccacgctaatcaacttgatctcactttcaggagcttcttcctagctggaaacccacagcgtggagtacaacaacaatctgtaggaagacaaggagaaacaacaatgcaagaaaggagatcagaacaagagagaacatctaaaggaggcaacattttcaacggtttcgacactgaaattttgtccgaagcattcaacgtggacgtcgaaactataagaagacttcaaggacagaacgaagagagaggtgtaattgttagagc

SEQ ID NO: 6274 - DNA, 837 bp, Artificial
  Synthetic
ggcttccatgtctaccattcttccattgtgccttggcctccttctcttcttccaagtgtccatggcacaattttcatttgggggaagcccacttcagagcccacgtggatttaggggagaccaagatagtcgtcatcaatgtcgttttgagcacctcaccgcccttgaggcaacacaccagcagagatctgaagctggattcactgagtactacaacattgaggcaagaaatgagttccgttgtgccggagtgagcgtgaggcgcttagtcgtcgagagcaagggcttagttttaccaatgtatgctaatgctcacaagcttgtctacatcgtccaaggtcggggagtgtttgggatggcactgcctggttgtccagagacgttccagtcagttaggtctccctttgagcaagaggtggcaacagctggtgaggctcaatcatcaatccaaaaaatgagagacgagcaccagcaacttcaccaattccaccaaggtgatgtaatcgcagtgccagctggagtagcccactggctatataacaatggtgattctcctgtggttgctttcactgtcatcgacaccagcaacaatgccaaccagctcgatcctaaaagaagggagtttttcttggctggaaagcctagaagtagctggcagcagcaatcgtactcataccagacagaacaactgagcagaaatcagaacatctttgctgggttcagcccagatttactttctgaagccctgagtgtgagcaagcaaactgtgttgaggctccaaggcctgagtgacccaagaggtgccatcattagagttgaaaatgggctccaggcact

SEQ ID NO: 6275 - DNA, 821 bp, Artificial
  Synthetic
tcaaccagcccaagtttccaataacatcctcaaatagctatggcgaccatagctttctctcggttatctatctacttttgtgttcttctcctatgccatggctctatggcccagctatttggtccgaacgtaaatccatggcacaaccctcggcaaggaggttttagggagtgtagatttgatagactacaagcatttgaaccacttcggagagtgaggtcagaagccggggttacagagtactttgatgagaagaatgaacaattccagtgcacaggtacatttgtcatccgacgtgtcattgagcctcaaggccttctggtacctcgatacagcaatactcctggcatggtctacatcatccaagggagaggttctatgggattaactttccccggctgcccagcaacctaccaacaacaattccaacaattcttgcctgaaggccaaagccagagccaaaaatttagggatgagcaccaaaagatccaccaatttagacaaggagatatcgttgcactgccagctggtgttgcgcattggttctacaatgaaggcgatgcaccagttgttgctctatatgtcttcgacttaaacaacaacgctaatcagcttgaaccaaggcagaaggagttcttattggcgggtaacaacaacagggagcaacaaatgtatggtcgctcaatcgagcaacactctgggcaaaacatatttagcggtttcaacaatgagctactaagtgaggccttaggcgtcaatgcattggtagcaaagaggctacaaggccaaaacgaccaaagaggagagatcatacgggtaaa

SEQ ID NO: 6276 - DNA, 1148 bp, Artificial
  Synthetic
ctattagcttaagtttccataagcaagtacaaatagctatggcgagttccgttttctctcggttttctatatacttttgtgttcttctattatgccatggttctatggcccagctatttaatcccagcacaaacccatggcatagtcctcggcaaggaagttttagggagtgtagatttgatagactacaagcatttgaaccacttcggaaagtgaggtcagaagctggggtgactgagtacttcgatgagaagaatgaattattccagtgcacgggtacttttgtgatccgacgtgtcattcagcctcaaggccttttggtacctcgatacacaaatattcctggcgtggtctacatcatccaagggagaggttctatgggtttaaccttccccggttgccctgcgacttaccagcaacaattccaacaattttcatctcaaggccaaagtcagagccaaaagtttagggatgagcaccaaaagattcatcaatttaggcaaggagacattgttgcactcccagctggtgttgcacattggttctacaatgatggtgatgcacctgttgttgccgtatatgtttatgacgtaaacaacaacgccaatcagcttgaacccaggcaaaaggagttcctattagccggcaacaacaatcgggctcaacaacaagtatatggtagctcaattgagcaacactctgggcaaaacatattcagcggatttggtgttgagatgctaagtgaggctttaggcatcaacgcagtagcagcaaagaggctacagagccaaaatgatcaaagaggagagatcatacatgtgaagaatggccttcaattgttgaaaccgactttgacacaacagcaagaacaagcacaagcacaagatcaatatcaacaagttcaatacagtgaacgacagcaaacatcttctcgatggaacggattggaggagaacttttgcacgatcaaggcgagagtaaacattgaaaatcctagtcgtgctgattcatacaacccacgtgccggaaggataacaagtgtcaatagtcagaagttccccatccttaacctcatccaaatgagcgctaccagagtaaacctataccagaatgctattctctcgccgttctggaacgtcaatgctcat

SEQ ID NO: 6277 - DNA, 567 bp, Artificial
  Synthetic
tcctgcacacacgcacaactgcagccatgctctcttttatcctcatccagaacagacagggcaagacccgtctcgccaaatggtacgccccctacagcgacgacgaaaagatcaagctcaagggcgaggtccaccgcctcgtcgccccccgcgaccaaaagtaccagtccaacttcgtcgagttccgcaacaacaagatcgtctaccgccgctacgcagggctcttcttctgcgcctgcgtcgacacaaacgacaacgagctcgccttcctcgaggctatccacttcttcgtcgaggtcctcgacgccttcttcggaaacgtctgcgagctcgacctcgtcttcaacttttacaaggtgtatgctattcttgacgaggtctttcttgcgggcgagattgaggagacgagtaaacaggttgttttgacgcggctggagcatctggataagctggaatagtagcgcgtgggagggacgcgtctttttttttacaaaaacccttttttttctggcgttatatattctccccccttacacttcttcctttgtcctctttaatgaagagaag

SEQ ID NO: 6278 - DNA, 533 bp, Artificial
  Synthetic
gggggagattatggcgattcgattcgtgttgctggtgaacaagcaaggtcagacgcgattggcgcagtactacgagcagctgacgatcgacgagcgccgggcgctggagggcgagatcgtgaggaaatgcctggcgaggacggaaaatcagtgctcgtttgtagagcaccggaattacaaggtcgtgtatcggcgctacgcttctctcttcttcctcgttggagtagacagcgaagagaatgagctagcgatactggaattcatccattgcgtcgtggagacaatggatcgctactttggcaatgtgtgcgagctggatataatgtaccatttggagaaggcccattttatcctggaagagatggtgatgaatggctgcattctagagaccaacaagagtaatattctggggcctatacagcttatggacaaatcgtcctagtaacaaagtacgtgtcgtccccaaggtagatttctgacgacctggatttggaaatctcgacgagctatggctggaaataaaggagactttg

SEQ ID NO: 6279 - DNA, 611 bp, Artificial
  Synthetic
  misc_feature (514)..(514): The residue at this position can be any nucleotide.
gcgatctcgacgagatgatcagatttattctgctgcaaaatcggcagggaaagactcgtctcgccaagtactacgtcccactcgaagactctgagaagcaaaagctccagtatgaggtccacaggctcgttgtcaatcgggatccaaaattcacgaactttgtcgagtttcgcacacacaaggtgatctatcgacgctatgccgggctcttcctttcaatgtgtgtggacatcaccgataacgagctggcctatctggagagcatccacctctttgtggaaattctagaccatttcttcagcaacgtctgcgagcttgatctggttttcaaacttccacaaggtttacttgatcctcgacgagttcattctcgctggcgagttacaagaaaccagcaaaaaggcaataatcgagcgcatggcagagctagagcggcaggaataagcatactcgatcgtctcagtttttcaaaacgcgataggcagcctccgggcacgcacaaaggcatcgagtntatcccaaaactcgagaactgccgttcggtcctggtgcctcttgtgcttgctcagctgtttaagcaaacaaagaagtgtaagaagtcattcgaattc

SEQ ID NO: 6280 - DNA, 426 bp, Artificial
  Synthetic
gttggaagggattcgggagagaagaagagagagagagagagagagagagagaggggggatgacgatccgattcatactactggtgaataagcaggggcagacaaggctcgcacagtactacgagtacctcaccatcgacgagcgtcgcgcccttgaagctgagatcgtccgtaaatggctcgctcgcaccgattcgcagtggtcttttggagagcatcgcaactacaaagttatttacaggcgttacgcatctctctttttcttggttggagtggatatggatgagaatgagctggccatattggagtttatacatttcatggtggagacaatggaccgctattttggaaatgtgtgcgagcttgatataatgatccacttggagaaggcgcatattatgttggaagaaatggttatgaatgggtg

SEQ ID NO: 6281 - DNA, 689 bp, Artificial
  Synthetic
ccccacacccctattggttgttgtactagggggatcctggttacattgaagatccatctttcaaccggaagaacgtcaattccaaaaacccaagcaaaccaaaaccaggcaaagttctcttttcaattgaataaagtcaaagtaatctattgctgattccttaatcaaaatcgagaagaaatatggggatcagattcgtattaatggtaaataagcaagggcaaactcggctggctcagtactacgagtacctcactttagaagaaaggcgtgctcttgagggtgaaattgtgcgtaaatgccttgctcgcaatgaacagcagtgttcatttgtggagcatcgtaattacaaaatcgtgtacaggcggtatgcatcactctttttcctggttggagttgataatgaagaaaatgaacttgctattttggaattcattcacctgttagttgaaaccatggatcgtcattttggcaatgtgtgcgagctggatataatgtttcatcttgaaaaagcacacttcatgctggaggagatggtaatgaatgggtgtgttgttgagacaagcaaggcaaacattctggctccaattcagctaatggaaaaggcatcataagtagtacactctgatccatggaattcgtaataaaccgatttgcttgtgtagtgtttacgttttgggatttgtgct

SEQ ID NO: 6282 - DNA, 631 bp, Artificial
  Synthetic
ggacccacgcgtccgcaaaaaaagaaagatctagtgtcccgtagcaatgaagatcattttcgtctttgctcttcttgctattgctgcttgcagcgcctctgcgcagtttgatgttttaggtcaaagttataggcaatatcagctgcagtcgcctctcctgctacagcaacaggttcttagcccatataatgagttcgtaaggcaggagtatggcatagcggcaagccccttattgcaatcagctgcgtttcaactgagaaacaaccaagtctggcaacagctcaggctggtggcgcaacagtctcactatcaggatattaaaattgttcaggccatagcgcagcagctgcaactccagcagtttgatgatctctactttgatcggaatctggctcaagctcaagctcaagctctgttggctttgaacttgccatctagatatggtatctaccataggtactatagtgcacctagtagcattaccacccttggcagtgtattgtactgagttttaacaatatagtggttcggaagttgaaaataggctcagatatcatcatattcgacatgtggaactcaggttgatatatcctagtacatcatcgtaactaattaccatcgttggtactct

SEQ ID NO: 6283 - DNA, 589 bp, Artificial
  Synthetic
cccacgcgtccgccttactgaaaaatcacaaacatcaaaacgttataagagttctctagcatccatcacatagccatgaagatctttgtcatcctctctctcctcgccctcgcagcgagcagcgcctcggcacagtttgatgcttgcacctatgggcaatgccagcagcagccgtttatgcaaccgatcatgaacccgtgcaatgagttcgtgaggcaacagtgcagcccgatgagcctaccttgggagcagtcacgcaggctacaactgagcagctgccaggtgatgcggcagcaatgctgtcagcagatgaggttgatggcgcaacaatatcattgccaggctatttgcaccatggtgcagtctatcatgcagcaagtgcagtttgatgctggctttgttggcgagccccaagctcaggcccaggcccaggtggctctcaatttgccctccatgtgtggagtctaccctaggtactgcagcactccatgcaaagttgctactggtcattgcggttcttggtagtgtgtaccatcatatatatatagttggataaataaagtgtcacacatcatcgtgtgtgtcatgt

SEQ ID NO: 6284 - DNA, 483 bp, Artificial
  Synthetic
tgcaccaacaccatcagcaccatcaacaccatcagcagcagcagcagcagctgcagcatcaactccagcagcagcagcagcagcagcagcaggagcacgctcgaggaggctggcaggactattatgctcggagggcaaggccctctgaacacgatcacgccgtgtgctgcatgcaagctgctccgacggaggtgcgcgcaagagtgtccctttgctccctacttctctccccacgagccgcagaaattcgctgccgtgcacaaagtttttggcgccagcaacgtctccaagatgctctcggaagttcccgaggcgcagcgaacggacgtttgcaaacagcctggtctatgaagccaacgctcggatccgagaccccgtatacggctgcacggggacgatctctggcgctgcagcagcaatctcagacgctccaggcggagctgagcgcaatgagggaggagatcgtgaggtaccgggtgcacg

SEQ ID NO: 6285 - DNA, 628 bp, Artificial
  Synthetic
atgcttcaggagttaccggaacatcaacggggcgatgccgggagttcaatggtgtatgaggcaaatgctagagttagagatccagtttatggttgtgttggagctatatcatctttgcaacaacaaattgaccatctccaaacacaattggcaattgcacaagctgaggttgtacacatgaggatgcgacaattttcatccatgtctagaggcggcggcacagccggaaactcgccggaaaacgtgtcaccatcgtcccgacacactcaaactcaaccaaccatgtccctttttaccatggacatggtggttgatcatgctaatgtgggggagtccttatggtcatgctagcttgtaatttatatagttcagactctttaaaatatcgttggatgcgggtcggatccatataaatacttcaatatttttgaagcgtttgaatagttagtaattatttagctagctagttgcttgactagcatgcttaactagtcttttcttatatttgctatcaatatcttactttattgtctgcttcaatttttttttttttttcttactatacatctttatatagcacatctctagctgacccctcaagagatgatgatgaccattattaaccata

SEQ ID NO: 6286 - DNA, 640 bp, Artificial; identical to SEQ ID NO: 4590
  Synthetic

SEQ ID NO: 6287 - DNA, 666 bp, Artificial; identical to SEQ ID NO: 4225
  Synthetic

SEQ ID NO: 6288 - DNA, 692 bp, Artificial; identical to SEQ ID NO: 4235
  Synthetic

SEQ ID NO: 6289 - DNA, 633 bp, Artificial; identical to SEQ ID NO: 4236
  Synthetic

SEQ ID NO: 6290 - DNA, 646 bp, Artificial; identical to SEQ ID NO: 4237
  Synthetic

SEQ ID NO: 6291 - DNA, 674 bp, Artificial; identical to SEQ ID NO: 4230
  Synthetic

SEQ ID NO: 6292 - DNA, 405 bp, Artificial
  Synthetic
cgcgtttgagtgaagatgtcttcagatcggaaggttctaagttttgaagaagtttcaaagcacaacaaaactaaggattgttggcttattatttccggcaaggtgtatgatgtgactccattcatggatgatcatcctggaggcgatgaagtcttgttgtcctcaacagggaaagatgctacaaatgattttgaagacgttggtcacagcgacactgcaagggacatgatggacaaatatttcattggtgagattgattcgtctagtgttccagcaactaggacatacgttgcaccacagcaaccagcctacaaccaagacaagacaccagaattcattatcaagattcttcagttccttgttccgatcttgatcttgggattggctcttgtcgtccgtcactat

SEQ ID NO: 6293 - DNA, 631 bp, Artificial; identical to SEQ ID NO: 4234
  Synthetic

SEQ ID NO: 6294 - DNA, 697 bp, Artificial; identical to SEQ ID NO: 4232
  Synthetic

SEQ ID NO: 6295 - DNA, 673 bp, Artificial
  Synthetic
  misc_feature (149)..(149): The residue at this position can be any nucleotide.
gggcttctctgcaaattaaccaacaaacacacacacactctctctctggaaaaatgagcgatctcaagtccaagtttttggatgtgtacgctgtcctcaaatctgagctgcttagtgacccagatttcgaatttactgatgattcttgnctatgggtcgacaagatgttggactacaatgtacctggagggaagcttaatcgggggctctccgttattgacagctacagtttgttgaatgatgggagagaactaaccagtgaggaaatctttcaagcatctgcacttggctggtgcattgaatggcttcaagcatatttccttgttcttgatgatataatggataactctcatacacgtcgaggtcagccatgctggtacaaattacctaaggttggcatgattgctgttaatgatggcatacttcttcgcaaccacatcacgagaattctgaagaaccacttcagagcaaagccttattatgttgatcttctcgatttgtttaatgaggttgagttccagactgcctctggacaaatgatagatttgatcacaacacttgttggagagaaagatttatcaaagtactcattgccaattcatcgccggattgtccagtataaaactgcttattattcattctacctcccggtggcatgtgcacttctaatggc

SEQ ID NO: 6296 - DNA, 354 bp, Artificial
  Synthetic
aattcggcaccagatcaaccgtgctggttcagagttcctaaggttggtatggttgccatcaatgatgggattctacttcgcaatcacatccacaggattctcataaagcatttccgtgataagccttactatgttgaccttgttgatttgtttaatgaggttgagttgcaaacagcttgtggccagatgatagatttgatcaccacctttgaaggagaaaaggatttgtccaagtactcattgtcaatccaccgtcgtattgtccagtacaaaacggcttattactcattgtatctccctgttgcttgtgcgttgcttatggccggcgaaaatttggaaaaccatattgatgtg

SEQ ID NO: 6297 - DNA, 809 bp, Artificial
  Synthetic
actacgccttcttttcaaatctggcggaggttcatcgcagcctcccctataacttgtccttcatccctctcacttgtatccgtatccgtatccaaatcccctcttcttaaaagccatagaagagctgcctctctccgctgctattgtgctacaagaatgggtgacgccattgctgatgctaacatggacgctgttcagcgccgtctcatgtttgaagacgaatgtattctggtggatgagaatgaccgtgttgttggtcatgacacaaagtataattgtcatttaatggaaaagatcgaagctgaaaatttgctgcatagagctttcagtgtatttctatttaactcaaaatatgaattgcttcttcagcaacgatcagcaacaaaggtaacctttcctttggtatggactaacacctgctgtagccatccactctaccgagagtctgagctcattgaggagaatgctcttggggtaagaaatgctgcacaaaggaagcttcttgacgaattgggcattcctgctaaagatgtcccagttgaccagttcaccccattgggtcgtatactttataaagctccatctgatggaaagtggggagaacatgaacttgattatcttctattcactgtccgtgaagttaacatgaaaccgaacccggatgaagttgctgatgttaaatacgtgaaccgagaacaactgaaagagcttttgaggaaagcagatgctggcgagggaggtctgaagctatccccttggttcagacttgtcgttgacaacttcttgtttaagtggtgggatcatcttga

SEQ ID NO: 6298 - DNA, 590 bp, Artificial
  Synthetic
atctttctgaagaatggaggaaatcatggatcctctccaaaagcgcctcatgtttgaagatgagtgcattttggttgatgaagatgataaggttgtgggtcatgattcaaagtacaattgtcatctgatggagacaatagttaaaggaaaagcactgcaccgggcattcagtgtcttccttttcaacaccaagcatgagttgttactacagaagcggtcggctaccaaggtaacttttcctttggtgtggacaaatacatgctgcagtcatcctttgtatcgagaatccgaattgatttcggacaactgcttaggggtaagaaatgccgctcaaaggaagcttttcgacgagcttgggattgtagcctccgaggttcctgttgatgacttcaccatccttggccgcattttgtacaaggctccttcagatgggaagtggggcgaacatgaactggattaccttctctttattgtcggtgatgtgacgacgcatcctaaccctgaggaggttgacgacattcggtatgttaccaaggagcaacttaaggagttgctcgaccaagccgaggcaccaggccaagacagtgtca

SEQ ID NO: 6299 - DNA, 681 bp, Artificial
  Synthetic
cgtttcttctctcgcttgtgattgtgagcattctatcgcctttcttactctctctcttctggatttccatccggattgtttactttcttccttccagtccgccaaaatacctagacacacgtagcccgcaatggcgtcatcattcaacgttgccgacctggccgagtatatcgatctggacaagcagagcctattgatctcggccgggtcaatcatcttcaacccgctcttctggaacattgtcgctcgtcaagaataccacaacaagatcctgacaaggctgttcgggggcagaccctacccggcctgctatgccctcgccataaccatcttctcgctgggccttctccgcgattggctgtacaagacggccctgtccgagcagccatcgcacccgctcctggagacgctgtattcgcaggctgccggatacaccctgttcatcatcggcaacatccttgtcgtctcgtcgacgtggcgcctgggcatcacgggcaccttcctgggcgactactttggcatcctgatggacgagatggtgacgggcttccccttcaacgtgacatcggccccgatgtactggggctcgacgatgaactttctgggaaccgcgctcgtctttggcaagcccgctggtcttgcgctgaccgtcggcgtgctcgtcgtgtacatcatcgccct

SEQ ID NO: 6300 - DNA, 610 bp, Artificial
  Synthetic
tttcattccgattctgcttatgaaatcttggaagagagccttgtaggattcactgcaacagaatcgattctcaacggcgcgacaaagagtgcacaccctgccgatatcattccattaccgccgtccgctgccggccaagccgaactcaaccagctgaaagagaactcgaagcctctatatgcagctactggcatgtcatccgaagcagatctttcaaaggagaccgatccagccaaggactatacggaacacaagtttctcgatctcagcaaacctctcctaatgcaggtctggaatggtggtttttccaagaagttctatctggaacaggtgcaccgaccccgccattataagggcggcgactcggcgccgctctttggtaacttcctagagccgttgagcaaaactccctggtgggttgtgcccacattgtggtggccatgtgttgctgttggcacaagtattgccatgcatggactctctgcacccgcaacagttggcttctggatttttgggttgtgcttctggactatcattgaatatgtccttcatagatgcctgtttcacttggacgagcacctgccagataaccgtgttggtatcacattac

SEQ ID NO: 6301 - DNA, 523 bp, Artificial
  Synthetic
gacaccatgaccaatctgccccttctcacccgaaaagaggtggagagccacaacaccaagagctcgtgctacgtgaccgtcgacaacctcaaggtctacgatgtgtcttctttcctggaggagcaccccggaggaggagacctgattgtggattttgccggtaaagacgtgacggagattatgggcgacctggtgtcccacgagcactcggaggctgcctacgagatgctggacgagctctatctggtgggaattctcgctacccccgaacaggaggccaagttgctcaccagagaaaaccgacacgacttcaagctggaaaagaacgccgaagacgaactcactgtcaccactgacttcacccgagactacaagaccaatcagttcctggacctcaacaaacccctgctgatgcaggtgctgcgcgccaagtggaccaaggagttctacctggaacaggtccacaagccccgacattacggcaacggaagtgcgcccatcttcggaaacatcctcgagcctc

SEQ ID NO: 6302 - DNA, 673 bp, Artificial
  Synthetic
actcccacagtcccactaatggactctctcactctcatttgtaccgccgctcttctagctgccggtggactttactggttcgtttgcatccttggctccgccgaggttaaagggaaacgcgccgtccaactttccggcgggtcaatcgagaaagagaatgtccaagacaattataaacaatactggtctttcttccgccgccctaaagaaatcgaaaccgccgataaagttccggccttcgtcgatacgttctataatctcgtcactgatatttacgaatggggttggggtcagtcttttcacttttccccttctatccctgggaaatctcaccgtgaagccacacgtattcacgaagaaatggctgtagatctaataggtgttaagcccggggctcgcattctggatgcaggttgtggcgttggcgggccgatgcgggctattgcggcccattcacaggctaaagttgttggcatcacaattaatgagtatcaggtgaaacgagcccggatgcacaacaaaaaagctggcctcgattccttgtgtgaagttgtttgcggcaatttcctgcaaatgccctttccggacaacagtttcgacggagcttattcaattgaagctacatgtcacgcccctaagcttgaagaagtgtacaaggagatctaccgggtaa

SEQ ID NO: 6303 - DNA, 691 bp, Artificial
  Synthetic
aagagagcattaagaggcacgagcactttcttgccttgcaactgggattgaaaccaggacaaaaggtcttggacgtaggatgtggcattggtgggccgttaagagaaattgctcgattcagctctacatcagttacaggcctcaacaataatgaatatcagatatcaaggggacaggtgttgaaccgcaaagtaggattggatcagacttgcaactttgtaaagggtgatttcatgaaaatgccattccctgacaatagctttgatgcagtgtacgcaatagaagctacctgccatgcaccagatccagttggatgctataaagagatttaccgggtgctgaagcctggtcaatgtttcgctgtgtatgagtggtgcatgaccgattcttacaaccccaataacgaagagcacaagaggatcaaggccgaaattgagctcggaaatggcctccctgaggttagattgacaacacagtgcctcgaagcagccaaacaagctggttttgaagttgtatgggacaaggatctggctgatgactcacctgttccatggtacttgcctttggatacgagtcacttctcgctcagtagtttccgcctaacagcagttggcagacttttcaccagaaatctggtttcggcacttgaatatgtgggacttgctcctaaaggtagtcaaagggttcaagc

SEQ ID NO: 6304 - DNA, 590 bp, Artificial; identical to SEQ ID NO: 4990
  Synthetic

SEQ ID NO: 6305 - DNA, 633 bp, Artificial
  Synthetic
gaattccagctgaccaccatggctctcaataaactaaagaatataccttctttaacaaacagttctcatagctcaattaacggcattgcatccaatgctgcaaattccaaaccaagcggagcagacacggatgatatcgatgagaatgatgaatctgggcaaagtattctattaaatattatttcccagctgaagccaggttgtgatttatctagaatcacacttccgacatttattctggaaaaaaaatcgatgttggagagaatcactaatcaattacaattcccagatgttcttttagaagcacactccaataaagacgggctgcaaaggttcgttaaagtggtagcatggtacctagcaggttggcacattgggcccagggctgtgaagaagccccgaaatcccattcttggagaacactttacagcttattgggatttgcctaacaagcaacaagccttttacattgcagaacaaacgagtcaccatcctcctgaatctgcgtatttttacatgattccagaatcgaatattagagttgatggagttgttgtgccaaaatcgaaatttttaggaaactcaagtgctgcaatgatggaggggttaactgtattgcaattccttgatatc

SEQ ID NO: 6306 - DNA, 856 bp, Artificial
  Synthetic
tttagatagagaaaagattcccattgttctaaagctatagggggagtttttgatggagagaaccaattccgtcgccgtttgccgtcgcagacaatggtggatatgggtctttccggatctgtatttgcggtggtgtttggtttcgtggcggttttgtggtttttcattcagagaaacagtgtccgcaaagataaaaataatgaccccgacaccaccagcaccactaccacaacggtgtatgatggagaatgcagatcaaaggacgcaaacgacgacgctgacatcatcatcgtcggtgctggcgttgctggtgccgctcttgctcacacccttggcaaagaggggcgtcatgtaaaagtgattgaaagagatttgacagagcctgatcgaattgttggagaactcctacaaccaggtggcttcctcaaattgcaggagttgggcttggaagattgtgtggagaacattgatgctcagcgagtgttcgggtatgctcttttcaaggatggaaagagcactcgtctttcttatcccctggagaagtttcacactgatgtatctgggaggagctttcataatgggcgtttcattcaaagaatgagagagaaagctgcatctcttcccaatgtgaaactggagcaaggcactgttacttctctgctagaagaaaacgggaccattagaggtgttcagtacaaaaacaaatctggggaagagttgaaagcctatgcaccattgaccatagtgtgtgatggttgtttctcgaatctacggcgaaccctttgcgacccaaaggtagaagtgccttcctgttttgttggtctggtcctggagaactgccagcttccacatgcaa

SEQ ID NO: 6307 - DNA, 843 bp, Artificial
  Synthetic
atttgatgtccatctaataagagagaaatgattcattcatcatgactgcctgaggttccatgtttgtctctcgccttaccttggcctctctctgccttatctttccgactttgttcttccattgttcacctgatcaccaccgaccgcgcgacatatcgcaatagaaggctgcggaatttggacattgcaaacaaccccagcgcatccgaacttgtgtatgcgactacgactgcaaatcagcaccaaagaatttaggcggtactggatattgattggtcgcatcccaagaaacgtggttcctctttcataagacgctcaaagcgcaaaatctcgaccggaacaaagcagcatcgctctccctctctcacacatcgcgacaagacattctgcgatctgaatcttcgctttcagagcccgacacatttacaccggtcggcgactgcttcgcatcgaaaatgttggactcgtacggagtccggaggtcggacaccaccaaagggccgcctctgcgcattctgtctctcgatggaggaggcgttcgtggttactccatgctcatcatcatccaggaactcatgcatcgcgcatttgtcgacatcgaagggcgcgcgcctcgcaggcatgaaattccaaagccctgcgatcatttcgacctaatcgtcggtaccggcacgggcggactcatcgcaatcatgctaggccggctgcgtctggacttggagacctgcaaggagctgtacgttcgcatgaccaagatggtgttcgaaaccgacaagacgattgccggcttcccataccgatctacgctgttcaaggccagcaggctggaagacgccatcaagc

SEQ ID NO: 6308 - DNA, 714 bp, Artificial
  Synthetic
cccacgcgtccgcccacgcgtccgacattcgttgtctgaacactaaaccaaaaaactccaaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccacctctgccgcccagtcttcttctgctgcccagtcttcctctgctgctcagtcctctgtcgccagcgctccccccagctctgcccccgcccagaccacctctgctgcccagaccactcccgtcattcccgttggcactggcactggcgttccccccgctggcaacaagaccaccaccggtgctcccaccgcccctaccagcggcgcttccaccatcctgcccggccttgccttcatcgccgctctctgcgcctttgccctgtaaggggtttgacaatgaacgacga

SEQ ID NO: 6309 - DNA, 567 bp, Artificial; identical to SEQ ID NO: 4273
  Synthetic

SEQ ID NO: 6310 - DNA, 641 bp, Artificial
  Synthetic
ggcactcaaccaggtttacgactcccaatatggccctcttcacagtgggagattatcttgccgaaaggctcgctcaaattgggattcgccatcatttcatcgtcccgggcgactacaacctcattctcctcgacaagcttgaggcgcacccagcattaactgaggttggctgtacaaacgaactcaattgttctctggccgccgaaggctatgcacgcgcttgcggcgtaggagtctgcgttgttacttacagcgtaggcgccttctcggccttcaacggcatcggcagcgcatatgcagagaacctccccgttatcctagtcagtggagcacctaacacgaatgatgttgatcaacatctcctgcaccacacgctcggggagcacgactttatctaccagtttgagatggccaagaggatcacttgctgcgccgtggccatccggcgagcatctcatgccccggaactgatcgaccgcgctattcgaacggcgcttctaaagcggaagccggtttacatcgaagttcccacgaacttatctggcgagccatgtgcacagcccggacctattagtgctgtagtcaagccgttcccgagcgatgcgccagcccttgacgctgctgttaccggtgcctctgaa

SEQ ID NO: 6311 - DNA, 634 bp, Artificial
  Synthetic
agcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggaggggcggcgtgaagcgcatctccgggctgatctacgaggagacccgcggcgtgcttaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtaaagagacccggatgtgccacgggtgggtttttagtagtaggattagtagtatcccaactcctggttgtgatttgctcatttccatagatgtaatgacattacgatttcaatcgtagcaaaattatttg

SEQ ID NO: 6312 - DNA, 504 bp, Artificial
  Synthetic
gtcgatagcactagcagcgccttctctcctctcctctccaagtaagtagctcttcttcgatcggctagaggcaatgtctgggcgcggcaagggcggcaagggattgggcaagggcggggccaagcgccaccgcaagcatctccgcgataacatccagggcatcaccaagcccgcgatccggcgccttgcccggcgtggcggcgtgaagcgcatcagcggcttgatctacgaggagacccggggcgtgctcaagatcttcctggagaacgtcatccgcgacgccgtcacctacacagagcatgcccgccgcaagaccgtcaccgccatggacgtggtatatgcgctcaagaggcagggccggaccttgtacggatttggcggctagaaaaattcttcttttggatagggaagaaactgccatagctcttcctggcattggaatttgtaaattttgttctctttgactatctttctggaaatttaaagtatgatcttgtactgttc

SEQ ID NO: 6313 - DNA, 523 bp, Artificial
  Synthetic
tattggttgtctagggtgctagagcagcagcagctaggaaatctctcgtcgtcgcggcaatgtctggaagaggcaagggaggtaagggattgggcaagggcggcgccaagcgccaccgcaagcatctccgcgataacatccagggcatcaccaagccggcgatccggcgccttgcccggcgtggcggcgtcaagcgtatcagcggcttgatctacgaggagacccgaggcgtcctcaagatcttcctggagaacgtcatcagggatgcggtcacctacaccgagcacgccagaaggaagaccgtcaccgccatggacgtcgtctatgcgctcaagaggcaaggcaggacgctctacggatttggcggctagaagaagaaaattagaagctctccatctccttggaaaatttctagttttcctcgatttctaactggtagacaaggaagaaatattttcctttgcattccatccaccactttgtaatattcgaatctaatgtagaatcttaaatcggaaaaaaa

SEQ ID NO: 6314 - DNA, 604 bp, Artificial
  Synthetic
ccccgcacctcatcaccaccgccgccaaccactcctcaccaagtcaaagtttcttcctcgcgaccggcggcgagcggcggcggcggcgatgtctgggagaggcaagggcggcaaggggctcgggaagggcggcgcgaagaggcacaggaaggtgctgcgcgacaacatccaggggatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaattcagt

SEQ ID NO: 6315 - DNA, 615 bp, Artificial
  Synthetic
cccgactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcttgcctccctccgccatctctcccatgtcgtctggccgtgcccacaagtcttgcggtcaagaaaaaaagtttgatggaaagccgtggaatccaccttgttcagttcgctgtttagtttttctagtgtttacctgaatcatgaaattgtgaagcaaatgatgtttgcaactgggatttgaattgaaacatgtttcagagcctaa

SEQ ID NO: 6316 - DNA, 566 bp, Artificial
  Synthetic
gctcgttcctctcttttaaattcaaaacccttgaattcactttcaattatctctttctcaagcttttgaaaaatgtctggacgtggcaagggaggcaagggattggggaaaggaggagcaaagagacacaggaaagtgctgagagataacatccagggaattacaaagccagctattcgcaggcttgctcgtaggggtggtgtgaagcgtatttctgggttgatttacgaggagactcgtggagttcttaagatctttttggagaatgtgattcgcgatgctgtgacctacactgagcacgctaggaggaagactgttactgccatggatgttgtttacgctctcaagaggcagggaaggaccttgtacggatttggaggttaaatattggcggttagggtttattgtattttgttgttagtgattgtagattttatgtttgtgctttctgtttgtgttagtggtcagtttaagctagggtattttaatttccgttgttaaggtctggacattgtaatacctcgttatacaattaagtaaaacagaccatttcctaaaaaaaaaag

SEQ ID NO: 6317 - DNA, 551 bp, Artificial
  Synthetic
gccattacggccggggacaatattccgaatcaagaacatatcttcccatatcgagctcaaatttcaaaatccccataatcgtttcacaaaatgtcaggaagaggcaagggaggtaaaggattgggtaaaggaggagcaaagaggcacagaaaagtattaagggacaacattcagggaatcactaagcctgcaattcggcgtttggctcgtaggggtggagtaaagcgtatttctggtttaatttacgaggagactcgtggggtgttgaagatatttttggagaatgtgattcgtgatgcagtgacatacactgaacacgctaggagaaagactgttactgccatggatgttgtttatgcgctcaaaaggcagggcaggactctttacggatttgggggttaaatttttcaaattagggtttttgtgggtaacttttattatagatttgtacttttgctgccgttgtgttttagggttgcttagattttggtaaggtcgatgatgtaattctcgttacatattcaaggaatagtaattgcttggtcctcaaa

SEQ ID NO: 6318 - DNA, 548 bp, Artificial
  Synthetic
gccattacggccggggatcgccctaatcattatctctcgcacaatttttcagcttcagggtctttaatttgcagagaaactaaaggttgattgaaaatgtctggacgtggaaagggaggaaagggattaggaaagggaggagcaaaacgacaccgtaaagtcctccgcgataacatccaaggtatcacaaagccagcaatccggcgtttggcacgtagaggaggagtgaagcgtatcagtggtctgatctacgaggagacacgtggcgtgctgaagatctttctagagaatgtgattcgtgatgctgtaacttacactgagcacgctaggaggaagactgtgactgctatggatgttgtgtacgcgctcaagaggcaaggccgtactctctatggttttggtggttagaatattggaattaattaatgttggttttacgtttaatgtaattatgttcttataagagtagttttggcaagaaacgttgttgcttaaattaatgaaattgcacactacatttttctcactattgatttgtcaatttgacc

SEQ ID NO: 6319 - DNA, 740 bp, Artificial
  Synthetic
tttggtaaaaaaccaggagacaagatatggagtaaattgttcatcctcattagattttcttagctttaagtttgcaaagattttcaactacaccgcattggctaacaacgacatcacaatagaaaacaaaagcagtagctaacactcctagatttactttagactaattcaaaccatttaacacagatctcagaaacaagaagaaatccccaaacttgcataaaccctaatcccccaaatcggattaacctccgaaaccgtagagagtacgaccttgcctcttcaaagcgtagacaacatccatggcggtcaccgtcttccttctagcgtgctcagtgtaagtaacggcgtcacggatgacattctcgaggaagatcttgaggacacctctggtctcttcgtagatgagaccactgatacgcttgacaccacctctacgagcaagacgacgaatggcaggcttggtgattccttgaatgttatccctcagaaccttcctgtgcctcttcgctcctccctttcccaatccttttcctccctttcctcttcccgacatcacttcacagttttacttgatacccaaagatctgtgactgtgaagaacagaagaaaaattattcagtgaatggtaacgaacagaaacgctagatttccaaatcaatcaattgaattgacgatcgaacaataaaccagatggagaagaagaagatacttttaagatgatttggcggacgcgtggg

SEQ ID NO: 6320 - DNA, 588 bp, Artificial
  Synthetic
ggggaaatggtctgttttacttaattgtataacgaggtattacaatgtccagaccttaacaacggaaattaaaataccctagcttaaactgaccactaacacaaacagaaagcacaaacataaaatctacaatcactaacaacaaaatacaataaaccctaaccgccaatatttaacctccaaatccgtacaaggtccttccctgcctcttgagagcgtaaacaacatccatggcagtaacagtcttcctcctagcgtgctcagtgtaggtcacagcatcgcgaatcacattctccaaaaagatcttaagaactccacgagtctcctcgtaaatcaacccagaaatacgcttcacaccacccctacgagcaagcctgcgaatagctggctttgtaattccctggatgttatctctcagcactttcctgtgtctctttgctcctcctttccccaatcccttgcctcccttgccacgtccagacatttttcaaaagcttgagaaagagataattgaaagtgaattcaagggttttgaatttaaaagagaggaacgagcttcgattgttttgatgccccggccgtaatggc

SEQ ID NO: 6321 - DNA, 564 bp, Artificial
  Synthetic
cggacgcgtgggcaaagctcagtttctctcttttaaattcaatttctattttctctctctcaaactattgaaaaatgtctggacgtggcaagggaggtaagggattgggcaaaggaggagcaaagaggcacaggaaagtgctgagagataacatacagggaattacaaagccagctattcgtaggcttgctcgtaggggtggtgtgaagcgtatttctggtttgatttatgaggagacacgtggagtgcttaagatctttttggagaatgtcattcgtgatgctgtgacctacactgagcacgcaagaaggaagactgtaactgctatggatgttgtgtacgctctcaagaggcagggaaggaccttgtacggatttggaggttaaatattgggggttagggttcatagtattttgttgttagtgattgtggatttcatgtttgtgctttctggttgagctagtggtcagtttaaggtaggttagtttaatttctgttgttaaggtctggatattgtaattccgcgttatacaatcaagtaaaacagaccattttaccctattg

SEQ ID NO: 6322 - DNA, 609 bp, Artificial
  Synthetic
tctgtttttgtgttagggaggaatatccatagccgtagccatgtctggtcgaggcaaaggagggaagggtctgggcaaggggggtgcgaagcggcatcgcaaggtctttcgtgataacattcagggtatcactaagcctgccattcgccgtcttgccaggaggggtggtgtcaagcgtatcagtggtctcatctacgaggagacacgtggcgtcctgaaaatcttcttggagaatgtgatccgtgatgctgtcacctacactgagcatgcccgcaggaagactgtcacagccatggatgtcgtctatgccctcaagagacagggaaagaccctctacggatttgggggttgaaacaccttctctctctctctctcttatactggtgttcttcaacaccaccattctgtagaaattggaagcttggttgaactgctttatgtgatgagacatgctgatgggatttaggggttcggatccttctgtaaatatctatggttttctatgctgatactctctatgcaatgaaaaagcatgaactcggtctctgtagctctgttggttaattctagattaaattgcccgtttctctatttgtatctctctctgga

SEQ ID NO: 6323 - DNA, 556 bp, Artificial
  Synthetic
accacgcgtcgttcaaatctaaaaccctaaagcttcttttatcttcaaatttctgtgtgaaaatgtctggtcgtggaaagggaggaaagggattgggcaagggaggagctaagaggcacaggaaggtgctgagggataacatccaaggaattacgaagcccgcaattcgtcggttggctcgtaggggaggtgtgaagcgtatatctggtctgatctacgaagagacacgtggagtgctgaagatctttctagagaacgtgattcgtgatgctgttacctacaccgagcacgccaggagaaagactgttactgctatggatgtcgtttatgcactcaagaggcagggcaggactctctatggatttggtggttaggttgtttaggtgtgattttaggtaactgtatttgtagtaattgtagattttctggaatttctgttgtctctttgttggtttctccgcagctttgttctagttgttgttcttaaggtcttgataatgtaatttctcattacagattcaaggaacaaagttcattttctagaaaaaaaacaacc

SEQ ID NO: 6324 - DNA, 587 bp, Artificial
  Synthetic
ctaccctcgaccacgcgtcgctgatttcagttcacatcaaaacttggaaggtctttaatcttcaagttcctgtgtgaaaatgtctggtcgtggaaagggaggcaagggattgggcaaaggaggagcgaagaggcacaggaaggtgctaagggataacattcagggatttacgaagccagcaattcgtcggttggctcgtaggggaggcgtgaagcgtatttctggtctgatatatgaggagacacgtggtgtgctaaagatctttctagagaacgtgattcgtgatgctgttacctacactgagcacgccaggagaaagactgttactgctatggatgttgtgtatgcactcaagaggcagggtaggactctctacggttttggtggttaaggaatttgtgtttgtgtttttgacttttgtttgttcttcaaaagtcttgcggtcaagaaattgaatgaagtattattaaaatagttgatgtaattagggttccttattagtatttgtagtagttgttgtaagaaaagcattctcaggtattctggaatttgctcaacttaatggcagaagaattcaagtttcaact

SEQ ID NO: 6325 - DNA, 576 bp, Artificial
  Synthetic
ctagaaatcaacttttctcctttcaattactctataaaaaatgtcaggtcgtggaaagggaggcaaaggtttgggtaaaggaggagcaaaacgacaccgtaaggtgctccgtgataacattcagggaatcacgaaacctgccattcggagattagcgagaagaggtggagtgaagagaatcagcgggctgatttatgaagaaacaagaggagtgttgaagatatttttggagaatgtgattcgtgatgctgtgacttacactgagcacgccagaagaaagactgtcactgcaatggatgttgtttactctttgaagagacaaggcaggactctttatggatttggtggttaaagtttgggaaattgttgttaacttctgtgttactatttggtgttattgttaatgtagttgactagattttcgtattaatgaaatgaaatccgttggttttattctcattcttgtgtccatttgattttgagtctccgagtttttgattgagtgggaattgtagtatttttgtttgtttgtgttgctttaccttatgagtttgcacaatgtttattcaaaattca

SEQ ID NO: 6326 - DNA, 624 bp, Artificial
  Synthetic
gccattacggccggggagaatccgaatcaaccacatttttgctcatttcaaattcaaaaatccccaaaaatctagtttcacaatgtcaggaagaggaaagggtggaaaaggattgggcaaaggaggagctaaacgacaccgtaaggtgcttcgtgataacatccagggaatcacgaaacctgcaattcggcgtttggctcgtagaggaggagtgaaacgtatttctggtttgatttacgaggagacacgaggtgtattgaagatatttttggagaatgtgattcgtgatgctgtgacttacaccgaacatgccaggagaaagactgttactgctatggatgttgtttatgccctcaagaggcagggaaggactctctacggatttgggggttagatttgtctaattagagtttttgtggggtaatgattgtagatttgttctttactatctgatgtattagggttggttagtttttgttgagattttataatgtaattctctattacatactcaggaatagtaattgcccaaaaaaaatctaacaagcttctagtagtatatataacaagctcgcattcttaaaatcataaatcttggaacaaggttttttcttttctttctag

SEQ ID NO: 6327 - DNA, 570 bp, Artificial
  Synthetic
cccccccccctgaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcaaaaaaaacaaaaaaaaac

SEQ ID NO: 6328 - DNA, 587 bp, Artificial
  Synthetic
cccacgcgtccgcgatttcagggctccccaagtagtagacttctctcttcttccatctcggattcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcttagcctcttctcctgtagctgttgtttcatctcgtctcctgttccttcattaattagggatgtatgaactactggttcgttcgttcgaatggaataggaaatctgcagtgatttaccctc

SEQ ID NO: 6329 - DNA, 521 bp, Artificial
  Synthetic
acatagacaagttagatttgaatttaagattgacagaaagatgtcgggcagaggcaaaggagggaagggtttgggaaagggaggggccaagcgacatcgcaaggtctttcgagataacatccagggcatcactaagcctgccattcgaaggcttgctcgtcgagggggtgtcaagcgtatctctggtttgatctatgaagaaacgagaggtgttctcaagatcttcctcgagaatgtcatcagagatgcagttacctacacagagcatgcgagaaggaagactgtcacggccatggatgttgtctatgccctcaagagacagggaaagaccctctacggttttgggggttgaactttcctttcttactttttggtcttctttacggtgtttgttaacaccactgcctttatgatctgagttacttttggcgaacttaatgtcatatacatgtctgttttatgtttcttgaacttgtagatgttttgaaaattagtaaagattggtgttgatttatggtgga

SEQ ID NO: 6330 - DNA, 97 bp, Artificial
  Synthetic
acgcccacgcgtacgatttggcaattcctcaagctcacccatttgttgactactggcagtgtagcacacagtctgctacaacaaaccacatcaccat

SEQ ID NO: 6331 - DNA, 100 bp, Artificial
  Synthetic
cccacgcgtccggggaattaaatcccctcgctgcactaccgcaaccaccgtcaacctcgctgctacctctcaattgaactcgactcgagctccgtcaatc

SEQ ID NO: 6332 - DNA, 388 bp, Artificial
  Synthetic
gtttcggaggctgattgagtcggaggggctgccttattgcggcagaggaatagtgacgtcatgactatcaaggaccctggaggttacctaaaagaaaagcatctggacgagtgttagagtgtgcgaatggatctcattgtttgaattgatgaatctcggaagatctgagctagctgcaagatgcctcaagccatgcgcaaggcacgtgtggatggaggcaagattggatggagatttactgtaaatcttccaactttaactatagaagggaaagggggaaagaggcgatcgctataccgctggttggattcagctccagggacagatttcatcaaaacaagcgatgaactgtgtggtgacatatatatacgagtacgggtttgatcat

SEQ ID NO: 6333 - DNA, 253 bp, Artificial
  Synthetic
atcctcttcaagaaggggaaactccccgagatgcatagaggagcagaatctctcgtcgtttgtcgggattttgcgctctctgtcaactgtgccaccacttagattgccttctattgcttgccaaaatccggttgtcaaatgaaccgcagtgcccatgttgattgtccagtgacttgaactcgaagcgggcgccaggcattccagccagaaacagtgctctgcatcggctctcattatgtagcagagggtgtgg

SEQ ID NO: 6334 - DNA, 410 bp, Artificial; identical to SEQ ID NO: 5198
  Synthetic

SEQ ID NO: 6335 - DNA, 552 bp, Artificial; identical to SEQ ID NO: 5204
  Synthetic

SEQ ID NO: 6336 - DNA, 550 bp, Artificial; identical to SEQ ID NO: 5202
  Synthetic
  misc_feature (174)..(174): The residue at this position can be any nucleotide.

SEQ ID NO: 6337 - DNA, 291 bp, Artificial
  Synthetic
ttttgatcctatctttctttactgagttgttttagttgtcaaccttaattccgagtcttcaatttaatactgatccaaaagtcttctaaggcaaagatggggagactatttgtgttgactcttgaaggcaagatctatagctgcaagcactgtggaactcatcttgctctttctgaaagcattgtttctaagtctttccactgccgacatgggaaggcttatctcttcagtaaggtagtgaatgtcacttctggcgagatagagaatagaatgatgatgactggtatgcac

SEQ ID NO: 6338 - DNA, 286 bp, Artificial; identical to SEQ ID NO: 5194
  Synthetic

SEQ ID NO: 6339 - DNA, 303 bp, Artificial
  Synthetic
gggggaatgcctccgccgatactaaccattaagccaaacttaatagatagaaaggtgtagatcattcaggtcgcgaacgttgctgcgcaggctataataatgttatacttgctgatcgaccccaaggtgtatggatttgggtcattcggcggttttggaagacagatgtgtctatcgtccagcatagccgtcgccacagcctgctctttggatgagcacatacccatccaacagtgtattcatcatgagttttagtcttagtagctagttatcagtagtaagaacaaataattctttccaact

SEQ ID NO: 6340 - DNA, 654 bp, Artificial
  Synthetic
gcccccatacaatctccaactcaactcaaccatgctatctgtggaccacaactacaactcatcacaacaatatcagcgctttcaacaacagcaacagcaccagtataacaacaacatcaccaacaacaacaacaacctgaacaaccatcatcagacaaagctggacgacttcacctttggcaactcgaccgactttgacttctcgacctcgaccttcccctcaaccgagctctctgtgtccaatctcgagtatctcaacgccgcaatcgcctctgcgttttcgtctgactcgatgcggcccgaatcctgggacgccgccgctcgcttctcaactcccaagtttggtcgtcttccccatcaacgagaatcctctctgtcttctctgggatctacggggccggcgtcgcccttcaactcgcacatcgcgaacccccacatcgccgtcactgacgccaatggtgacggcttcatggacatgcactcgcacgacatgaccatgagctcaggcccttactaccagctggccgccaagacgatgcctccctactcaaacttccatcatctcgacaacgcctctgtcagcgagatggcatatccagtctccatcccgaccaacagccaccacaagctgcgacaggatcgcaacctcctccc

SEQ ID NO: 6341 - DNA, 529 bp, Artificial
  Synthetic
tcaaaacacagcacattcgacaccatgctcggcctccgtaccgctacgcgcgcctcgcaagcgctccccgctttccgcaacaccgctgcccgccgctggacctcgggcattggcgcgaagggcttcgagggcgccgccgacaacgccttcaaccgcgagagggccgctgtcaagcaacacgccgccgacacttctggcacctggcgcaagctctcgatctacgtcgtgatcccctccatcatcctcgccggcgtcaacgcctacaggctgtggatcgagcactgggagcacgttgctcacggccccgctctcgaggacaagcccgagtaccccttccagaacatcaggaccaagaactacttctggggagacggtgacaagaccctcttctggaaccccaaggtcaactaccacaagaaggagtaaagtagaagcctttggaacttgagaagtatgcgccggtgatttgggtctagaggacggaacacgcaagtccacccgacgggaccgctgctacagcagcagtgtg

SEQ ID NO: 6342 - DNA, 764 bp, Artificial
  Synthetic
ttattactcgaccacgcgtcggtttgctggcaggacgacatctccaccatagagtcgactcattgctggcatacggagcattccaatcttactcgtagtagtgttattgccatcgctcatcatgctgcccaaggcgatcatcgcgattgccgcattggctttcagcccagcaaatgcgctgtggcccattcctcagaagatctcgaccggagacagcgtgctctttattgaccaggctgtcagggtaacttacaatggagtgccgatcatccctatcggctataacccaccggccagctccaacttcgacagcaggcaaatcgtccaaggcgctgtctcgcgtgcctttcaatccatcttcaacaccaactatgtgccatggaagcttcacccgcgtaacagcaactttgagccgaaggtggcccctctgaaccgaatccagtccatctcaattcagcagactggaaaggacacttccaagacgttcaagccgcgcgccggagatgttgatgagtcgtactctctgaccatttccaagaatggacaggtcaacatcagtgccaagtcctccactggtgtgctgcacgccctcgagaccttctcgcagcttttctacaagcactctgctggacctttctactacacgacacaggcacccgtgtccatcacagacgcacccaaatacccccaccgtggcatcatgcttgaccttgcccgtaactatcaaaccatcgatgacatcaagaggaccattgacgccatgt

SEQ ID NO: 6343 - DNA, 440 bp, Artificial; identical to SEQ ID NO: 4289
  Synthetic

SEQ ID NO: 6344 - DNA, 622 bp, Artificial; identical to SEQ ID NO: 4290
  Synthetic

SEQ ID NO: 6345 - DNA, 711 bp, Artificial
  Synthetic
aaaaggtagggcacacgacaaacttggccccgtcagcaaccagcgcacggcatgcctcagggaaggccaagtcccagcagatgatgagtccgacacgaccccagggagtatcaaacgccctgtgcggcgtcaatccatcggctgtcagatgatctctctcggggtgccacaagttcttcttctggtagcgtcccagaacggcgccgtccggaccgataaagtacgccgcattcgcaattccttcagtcatggaggcattgccttcctccgcagggatgggctctaggatcgtgcccggagcaatggcgatgccgagctccttggcaatggcctgatattttgcaagatacggcgtctgctccttggccgttgcgaggaggatcttggagtcgggcttccatgagccgagatggtactcaggaaggacgaccaggttcgcgccctgggaggcggccttgcggatgtatgactctgcgcgagcaaagttgccagctacatcgagcggctagagttggtgaacaattaggagacaagatcagccttcataattgcttcagctgcagcaggggttgttggtggcacacgggcgacgaatgccaagcaatacgtcagatacgcaaactcaccttggaatacagctgaaccagcgcaatcttcaaattcgacgccattgtcacagaaaatcaaatgctaacacaagtcaaagtgtac

SEQ ID NO: 6346 - DNA, 633 bp, Artificial
  Synthetic
aatcatcttacaaaagcttcccaaaatggccccggtattaaagattgcacttattcagtttcaggccaagcctctttgtgtgcaagaaaactttgacaaagcggtttcagaaatccgatccgctgcctctcaaggaagccatttagttgtattgccagaatatcacctcacatcatgggttccagaggacccttcctttgctacagcctgtgcagcttccacgcaatatctttcacagtatcaaaagctagctagggagttaaatgttcacatcgttccaggtaccattgttgaacctgttactatccaaccatcaaatgtcgttgctacttctcatgcagagcaagacgtacttgcaggtgatctcatagtggagctacacaacaagacatacttcatcgctgcaacttctggagatatcctaggaacataccaaaagaaaaacttgtggcacgtcgagcgcggcgttttgaccgctgataggcgaacgccgcacaaggcgtttgatgttccactccccggtggccatatcgtgcgagtcggtctgcttatatgctgggatctcgcctttccggaagccttgagacaattagctgcggatggtgcaaagattgtcgttattcctgcctactg

SEQ ID NO: 6347 - DNA, 492 bp, Artificial
  Synthetic
atagaggcgctgtgtttaattaaacgcctgagggccgaagtcattcttgcatcaattttagtgcggtatagggaactcgtcaacgcaatctcgctcgaagcaaatcaccaagttcgggtgtagagatatgtgcgtaggttataagaagtggacaataagatactgttgcgtacctgtaccgagtagaaatgcaggatatggctgccggtagggctcgttcttcggatggtaaaagtcgtgccggtcgatcaataaacagaggcaggagcatggatttcacacgcgtggctagtcaaacgaaggcgggagaggaaagcaccaggagaacctgttgtagtattctgggactgcgatagggtcgcttctcaggcgacaggaatggcttcgtctggcgagctttccgcgtcccgcggatggaacacagcatagtacaacacatccttcggaatatgcccctggtagggagaccaatggtaaatcgggctcagtagg

SEQ ID NO: 6348 - DNA, 642 bp, Artificial
  Synthetic
tgtaaaacgggtgtgtccggtgcacactgtcacggcataatggcaaccaaggcggccaaggcggcaaagagccacgagcatgacaagcgcaaaggcgaatcagccctcagcgactttgcggaatatgtagagcaacagcagaacctccggtatccatcctcgaacaagaagcccgttcccgactcggcagagcacgatgcggagctggacgagcttctagacagtctcaatctagtcgactctgcgccgcggataaagctcagagaccttgtgctcggaacggacgatgacacgttgcggaagctcggggatgtcatcacggagcggatagaagagggcgccggggagactgtctttgatcttggattcgagaacagcggcgaatcaatgcagctgacactggacgagtggaatattgcgtatccaagactggtcgaggctgcgaaaaaggtgcgcgcagattgtcagcttctcctgacgaccaatgtcggcggcaaggaagaggctgagagcacggccaccaatccgaccaaggacaagagctgtagcggcaagattcttatccggaggataccagacaaaatagaagacgtcattgagactcggatagctgtagttggcaatggtaagcttcccgtatgg

SEQ ID NO: 6349 - DNA, 891 bp, Artificial
  Synthetic
gtgccttgttgcagcatcccgtaacccctgcaggataccgccctaagccgcccaatttctcgtcactggctctagctttttgctgtttatcccgaaatgggcatcgaatggcttctgttccctccccccctatgatgtgtggcttgaccagtcgatgacgcaaacatggaagccggcttcctttctccttcttggtcggaatgcctgggaagggccaagatgacgagccacggcaataaatagtacaagcttcgcagaaaccttcttgtccgctcttctcccttttgtgtctcacacagcttttcttcatctttactccgcgatcttcttgatcttcaccaaaacaacatcattgcgcccttgaagccctcttagcaaatattcgatatacccaaaaggcattgagcccttgagccttacgagaaacacatatatccaacatgcctttcaccgctagcgatatctgcaagattattcttgccatcattctgccacccgtcggtgtcttcctcgagcgaggctgcggtgcagacctcttgatcaacatcctcctcacaatcctgggttacttccctggtatcatccacgctctgtacatcatattgaaatactaagcccgccttccgctcccgtatcccgccggattcaaagcgtcatgtcgtcgcaccgcatcatgttgtgcagacaccaattactcccacgtttgaccggcaattgtcgttttagaatggatgcgtcagtggaggagtgaaggttacggtcgccggctcaccacgtggccggtcatagacgccataatgacagtgggctttcctttatggcttttcttttgttttttcttttcctctcttgttggctggaggcagatgcaccctatttgaaagggggcgt

SEQ ID NO: 6350 - DNA, 224 bp, Artificial
  Synthetic
atatgttgctggttatggtacaattaatacttgaagatgatgtagagggcatggatgataccgggaatgtatccaagacaacagaggaggacgttgatgagcaggtcagcggtgcatcctcgctccatgaaaactccaacgggggggaggaagatagcaacgatgatcttgagaatgtcggaagaggtgaaagccattgtgtttgtgtttgcggacgcgtgggt

SEQ ID NO: 6351 - DNA, 529 bp, Artificial
  Synthetic
gctacccatctatcaacaataaacctatcaaccaagacacatgacaccacccccaaaacaaaccccacacacaaaccgccacaatgcctttcaccggatccgacatcatcaagatcatctgcgccgtcgtgctcccgcccctcggtgtcttcctcgagcgcggctgcggtgctgacctcctcatcaacatcctcctgaccgtcctcggttacatccccggcatcatccacgccctgtacatcatcctcaagtattagatgcgtcgccatcaggcaccagcatgagcgcgcaccacccacccgccacctgctacgccgagcaaactctacgtgaacccaccaaacatacgatacccccaaagcgagaggaaaggaagcatgcagcggcggcataatttacacattgtgttgaattacggaacggatcgccgagctttgacagcgaggcgaggcaacccttttttacgagcttgcttttatgagattgagtagtaatgtctgtactacaattctgaaaaatcatccaccta

SEQ ID NO: 6352 - DNA, 520 bp, Artificial
  Synthetic
ctcgagcttgcggccgctaaaagttaaagccatggctgcatctttctctgtcccctctatgataatggaagaagaagggagattcgaagcggaggttgcggaagtgcagacttggtggagctcagagaggttcaagctaacaaggcgcccttacactgcccgtgacgtggtggctctacgtggccatctcaagcaaggctatgcttcgaacgagatggctaagaagctgtggagaacgctcaaaagccatcaagccaacggtacggcctctcgcaccttcggagcgttggaccctgttcaggtgaccatgatggctaaacatttggacaccatctatgtctctggttggcagtgctcgtccactcacacatccactaatgagcctggtcctgatcttgctgattatccgtacgacaccgttcctaacaaggttgaacacctcttcttcgctcagcagtaccatgacagaaagcagagggaggcaagaatgagcatgagcagagaagagaggacaaaaact

SEQ ID NO: 6353 - DNA, 684 bp, Artificial
  Synthetic
cggtaatcgaattatcagcatccgcctgtcttgtctgtttcggtatcttgatagtggcagcgacagtacatatcaaaagatgatgcgaatagcttcacgagctccccagcgggcgtgctctctggcctcctcttctgcatccgccgttcttcgtcgatccatcccgcgctctgttgccatccgcgccattgcaacaaccgctcgcatggctgctcccactcagaccatcgctcacgcagcgccggccgacgcctatcagctgctgcccgagtcgcaaaaggccggccaggccgaggatgctctctacgaggcccaggtcaaggagattgaggagtggtgggcatcgcctcgttatgccggcattcgacgcccgtacagcgccgcagatgtcgcatccaagcgcggcacgcagttgatcaagtaccccagctccgtcatggccaccaagctgtttaacctgatccgcgagcgcgaggccaagggcgagcctattcacacaatgggcgccatcgatcccgtgcaaatgacccagcaggcccctcaccaggaagtcctctacatctccggctgggcttgctcctccgtcctgaccagcaccaacgaagtgtctcccgactttggcgactacccctacaacaccgtccccaaccaggtccagcgcctcgccaaggcccagtccatgca

SEQ ID NO: 6354 - DNA, 663 bp, Artificial
  Synthetic
ttagtcttctggatctccttgtttcttcatcctctattcaattgacttgattcactcttgtctaacaagcagtgaccacttgcatcattcatcatggcctccaacaacatggtgacgctggctgtgaatccagacaaagaagacgacctcttcctccaagaagtccagcaggtcaaagattggtggcgcgattcacgatggaggcacaccaagcgtcccttcactgctgagcagatcgtttctaagagaggccatctgaaaattgagtatcccagcaatgcccaggccaagaagctatggaacatcctggagaaccgttttcagaacaaagatgctagctatacctatggctgcttagagcctacaatggtcactcagatggccaagtacctcgacaccgtctatgtctctggctggcagtcgtcttcaaccgcctctgcgtcagacgagcccggccctgacttggcagactacccatacaccactgtgcccaacaaagttggccacctcttcacggcccagctcttccatgatcgaaagcaacgccaggaacgcttgagcacccccaaggctcagcgtgccaatgtggccaatattgactatctacgacccatcatcgccgatgccgatactggccatggcggtttaactgccgtcatgaag

SEQ ID NO: 6355 - DNA, 1068 bp, Artificial
  Synthetic
agcatttgtatagaaacaaacttgtatccactaaacaaaaaaattgagttctagccatggctgcatctttctcagttccatcaatgataatggaagaggaaaggagatttgaatcagaggtagcagaggtgcaagcatggtggaactcagagaggttccagctaaccaagaggccatattcagctagggatgtggtggcactaagaggtactatgagacaaagctatgcatccaatgagttagccaagaaactgtggagaacactcaaaactcaccaagtcaatggcactgcctctagaacttttggtgcacttgaccctgttcaagtcactatgatggccaaacatttggactctatctatgtttctggttggcagtgttcttccactcacaccacatccaatgaaccaggccctgatcttgctgattacccttatgacactgttccaaacaaagtggaacatctgttcatggctcaacagtatcatgataggaaacaaagggaagcaagaatgagcatgagcagagaagagagggctagaactccatttattgattatttgaagccgattattgctgatggtgatactggatttggtggtgctactgctactgtgaagctttgcaagcttttcgtcgagcgcggtgctgctggtgtccacattgaggatcagtcatctgtgaccaagaaatgtggtcatatggctggtaaagttcttgttgctattagtgaacacattaacaggttggtggctgcaagattgcagtttgatgtgatgggaacggagacggttctcgtcgctcgtactgatgcagtagcagcaaccctgatccaaaccaatgtggatacgagggatcaccagtttatcttgggggtatcgaacccgaatctgaaggggaaaagtttggctactcttatgtccgaagccatggcagcgggcaaaaccgggcctgaacttcaagcccttgaggataaatggctggcaatggctgaactcaagacattctctcaatgcgttattgatgcaatcaagaaaatgaacgttacggagtccgaaaagcagagga

SEQ ID NO: 6356 - DNA, 685 bp, Artificial; identical to SEQ ID NO: 4295
  Synthetic

SEQ ID NO: 6357 - DNA, 660 bp, Artificial
  Synthetic
acattctcccataccccaagcacctctacaaaggaaaaagaaataacccccatggcaacccacgtcatccaaggtcggagttacaagtagaaacttactcgcacacgttagactgactgttagtactacaataagatggagggaaaacacagagaccgcacgttgttacaggatacagaccagacagcgcagccgcgagctgataaagctagagagagggaaaaaagtgttggcagagaagtgagcgatcctggaggcgccgagggcattgtaggatccaagtatttgagccctgaccaagctaggtcagcattgcctcaaaccaccaagagtcggtccatgggccggcatgggggaagaaacagagattccaggatggcatcttgatcgaagaggataattctggggcaaagacggccttgagccagcaagagattccgcctccacggcggcggcggcggcagcaattacggcagcagcatgacgagcagccggagccaaagaaaggcaatgacaatagtgctctaaggttgcggctggacctaaacctcgacatagagattgaactcaaggcgaagatccacggagatatcactctgaccctactgtaagtatcttcttctgtgaatgagctatccaactgtgctaacatgtcattaa

SEQ ID NO: 6358 - DNA, 609 bp, Artificial
  Synthetic
aacgggcctccatcgactccagaccatccacgacctacacggaagtggcaagagatcgaaatcgtctgcagcttacccctgcaacggccttaacaagctcccgactcggcgggaagctatagcgatccaagccgctcttgtctcgtatataaccaagagctagacttcgcattagatagttcttcgtccttgtgtctgaggacaactcccttcttcattacatacaattgattcaacctgaccacaatggctgacgttcagtccattcgggcattcggcaaagcccgctccaccatcgagggcaagcccctgtctgacgaagaaatcaagcaatacaatgattatttcaaagccagctgctacctttctctgggtatgatctacctgcgagagaaccctctccttcgcgagcccctcaagaaggagcacttgaaatctcgtcttcttggacactttggttcagctcccggacaaatcttcacatatatgcacttcaaccgtctcatcaaaaagtacgatctggatgcctatttcgtgtccggccccggtcacggtgcccccgccgttctttcgcagtcttatctcgaaggtgtctattcggaagtctac

SEQ ID NO: 6359 - DNA, 580 bp, Artificial
  Synthetic
atctcaatatatatccacaatgaatcgaaaacattccgagactggcatcaccgacgaggcggctattgaaggccatgacctcattcacaacgccgagattgaggagcagagggtatatttcaaccactaatgtcgtatcttgggttacacgattctaataatgttttaaaggctcatggcgaccaggcattgacgcagccagacgagggagatgcgccgctcaacgcaacgaagcagtccgagcccgccatggcgggacaaaccggacgccgccattcagcgatggacaagataaaggagacactgcatctcaagaaataaatgagagatgaaaaagatgaggtcggaaataattacaaaaaaatggtcaaactgatgatacctggcggatgggcagtctggatggtgggacgaaaacaaaagaaaaccacaaataaagaggaagggcacgtgtgtgtcacgtttcgtcaaagtgtattatatgaattccccacatccgccctcgaatttcgttgtctgattcggtcgccgcagtaggatatttatctttttctcaatacatgaattattattattttta

SEQ ID NO: 6360 - DNA, 541 bp, Artificial
  Synthetic
gggtgacagctcaactgaacaatctcaatatatatccacaatgaatcgaaaacattccgagactggcatcaccgacgaggcggctattgaaggccatgacctcattcacaacgccgagattgaggagcagagggctcatggcgaccaggcattgacgcagccagacgagggagatgcgccgctcaacgcaacgaagcagtccgagcccgccatggcgggacaaaccggacgccgccattcagcgatggacaagataaaggagacactgcatctcaagaaataaatgagagatgaaaaagatgaggtcggaaataattacaaaaaaatggtcaaactgatgatacctggcggatgggcagtctggatggtgggacgaaaacaaaagaaaaccacaaataaagaggaagggcacgtgtgtgtcacgtttcgtcaaagtgtattatatgaattccccacatccgccctcgaatttcgttgtctgattcggtcgccgcagtaggatatttatctttttctcaatacatgaattattattatttct

SEQ ID NO: 6361 - DNA, 685 bp, Artificial
  Synthetic
aagttgctgactgaccaggtgtaactaggagcgggcagtagtacacagtctttgtcttgtctttgtcttgtttcttcgttgatataccgccgcctatcatgcgccgtctcctctccgtcagcgcctctgccagtgcccgcggattgactgccgcttcccctcggtctaccattgcccttgccaagatggcctccaaggctcaggctgccacagccgtcaggaggattcatgccacggctcagcagctcaagccaatggacgccctgtcgtccacggccaccagcttccccacgacgcacgagcagatcgagaatgtgcagaacacgccctacttcatcaacaacaagtttgtccagtcgacgacggacaagttcatcgacctgcccgacccggccaccaacaacctggtgacccgcgtgccgcagatgacgcaggccgagatgaaggccgtcatcgagagctccgagaaggccttccagtcgtggaagaacaccaccgtgctgttccgccagcagatcatgttccgctacgtgcagctgatcaaggacaactgggacagactggccgccagtatcacgctcgagccagggcaagacctttgctgatgccaagggcgatgtgctccgtggactgcaggtcgccgaggctgccgttggcgcccccgagctgctcaagggcgaggttc

SEQ ID NO: 6362 - DNA, 608 bp, Artificial
  Synthetic
gcaatcacttgatctttcattaacaagtgtaatatcaaaagtcacttcagtctattcggactcacatccacaccaaaccaagtcaccgtcataagatatcaacatgaaagctatctgggccactctacttgtcgtggccacgtccgccctcgccagccccgtcgccgaggctgctccaaacgctgatcctggcggttacggggattatggagactacggaggatatggaaaatacggcgattacggaaaatacaaacccccgacgccgccaaagggaggaggatacggagattataagacatacccaccaccgaagggaggctatggcgattatggaaagtatccacgggaagaggtacccgagtaacacggcgtgggtcaggctacaagacagcttacagtagttgacagctaaagaagcttgaaaacccaagtcagaatttacttattcgggaaattctaccctatatggattgctgtgactgttttcatgatgacaatatttcatgtacgtgaaatatacgttgctcactagatgtctaatgtagcatttacactatcaatggggtgttctccgataatgtctcgcttgataacgtccaacttcc

SEQ ID NO: 6363 - DNA, 561 bp, Artificial; identical to SEQ ID NO: 4298
  Synthetic

SEQ ID NO: 6364 - DNA, 610 bp, Artificial
  Synthetic
gagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgt

SEQ ID NO: 6365 - DNA, 613 bp, Artificial
  Synthetic
gctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcggc

SEQ ID NO: 6366 - DNA, 99 bp, Artificial
  Synthetic
aattctggatctgcttgagccttctttcttcactgtccgctcccaattgtcgcctcggttccacggcttcggattggaacacgcgcccacagacagaac

SEQ ID NO: 6367 - DNA, 100 bp, Artificial
  Synthetic
ctcaaataaaccactcaatcgattccttgataccccttgggacaaatctacttgttctctccaaacttacccctccaaataccatcatcaccatcaccat

SEQ ID NO: 6368 - DNA, 442 bp, Artificial; identical to SEQ ID NO: 4308
  Synthetic

SEQ ID NO: 6369 - DNA, 701 bp, Artificial
  Synthetic
gtgcagctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggattgttctcttcatcctccagtttggatacgtcacatcgctcttctccagcagtgccgacgtcgttgccgcagctgctggtgtcggcagccacttcatcctcaacaacttgcttcactctgcattcgtcatgctctttgtgaactcgcacttccacatcgccgaggtcatactgattctcaacttcttcaacctcagctcactgtatttccgccacaacacggtcccgcgcttcattcacgtccctgttgctacaggcccgttggcatgga

SEQ ID NO: 6370 - DNA, 676 bp, Artificial
  Synthetic
ccatgtacctctgggatccttcacaaggcacaaagccggttgcacggcttctgggacaccaaaaggccattaaccacgtgacattttcccctgatggcagtctcatcgcgagtgccggatgggacaatcataccaaaatctggagcgcaagggatggcaaattcatcaacacactccgtggccatgtcgcgcccatataccagtgtgccttttctgccgatagtcggctccttgtgacggcatccaaagataccacattgaaagtgtggtcgatggctacgtgtaagctggccgttgatctaccgggacaccaagatgaagtttttgccgtatgtttgcccccttgcccttccaattttgttaacccccgagcctgtggctgacagcgtgctaggttgattggagtcctgatggacaacgagtaggcagcggaggaaaagacaaggccgtacgcctttggatgaactgatgacgatgatgggagcgaatcaaaaaaggataaatcatgtgtgttatcggcgtccagtcagggattgattacgtgtatgttctaggtctagactctgtagagctgtttgtgcagcatccgctaatgatagagagcaaatgtggcatttgcccaagggcacggctgatgcaatttacatgaagcacttgtgaacaaggctcaatggac

SEQ ID NO: 6371 - DNA, 588 bp, Artificial
  Synthetic
ccgtttcttctcacatcggcgagttcgcggcctcctccctccaggctccacttcccagacgaatcggcggcagcggcggcggcggcggtgatggagtgcgttatcggggtcgtcggccgcgacttcgcggtggtggccgccgacacatcggcggtgcagagcatcctggtccacaagaccgacgaggacaaggtgatggtgctcgacagccacaagctgatgggcgcgtccggagagcccggcgaccgggtgcagttcaccgagttcatccagaagaatctccacctgtatcagttccgcaacaacatcccgctcagcaccgccgccaccgccaatttcacccgcggcgagctcgccaccgccctgcggaagaatccgtactatgtcaacgtgttgcttgctggatatgattcggatgttggtgcctctttgtattacattgactacatcgcaacattccataagatcgaaaagggtgcctttgggtatggctcctacttctgtctctcgctgatggacaagttatatcgtccagacatgtcagtcgaggaagctgttgatcttgttgacaagtgcattaaagaaatt

SEQ ID NO: 6372 - DNA, 655 bp, Artificial
  Synthetic
gcaatggagacgatcttcggattcgtgggcgatggctacgtcatcctgggcgccgacacctccgtggtgcagagcatcgtcgtccagaagacgaccgaggacaagatcatgcagctggattcacacaagctcatggcgacgagcggcgagtccggcgatagggtccagttcgccgagtacatccagaagaatataaatctctaccagttccggaacgggattccgctgtccaccaccgcggccgcgaattttacacgaaacgagctggctgtggcacttcgaaagaacccatactacgtgaatttgatgcttggaggctttgacaaaggcaagggaccgtcgctttacttcatggactacattgctactcttcacctgttggagaagggagccgtcggctatggcggctacttcgtgttgtcagtcatggacaagttctaccgcaaagggatgtcggtggaagaaggcattgctcttgctgacaagtgcatcgcggagatccgcaagaggttgattgcatcgccacacactttcgtactcaagatcgtggacaaggatggtacccgggaccttgcctggaggagcttggatgctgctgttccagcgggaccgcctccggtgatcaatccgggagacgcctccacatccatgcaag

SEQ ID NO: 6373 - DNA, 616 bp, Artificial
  Synthetic
aactctgcttaacgctgcttgttctccaagacagacgccttcaaagctcttattcgaaaccaaacctcagatttgtgtgtgagaaatcctcagaactttttcctagaagaagatggagtgcgtgttcgggatggtgggcaatggatttgcactggtggtggcggattcatccgcggtgcacagtatactggttcacaaatccaacgaagataaaatcatgatcctcgattcgcacaagctcatgggagcgagcggtgaagccggcgacagagctcagttcacggagtatgtacaaaaaaatgtggcgttgtaccagttccgtaatggtattccgttgactacggctgctgcggctaattttacaagaggcgagcttgctacagccttacgaaagaatccttacatggtgaacattatcctggctggctatgacaaggagacaggcccctctctttattacgttgattatatcgctactcttcacaaagtggacaaggcagcatttggttatggttcctatttctctcttgccatgatggataggcactaccggaaggacatgacagttgaagaagctgttgatttagctgataagtgcatcttggagatccgatct

SEQ ID NO: 6374 - DNA, 507 bp, Artificial
  Synthetic
tgcagataacaggttcagtagttctgaccacatcagttctttttttcctggatagaacttaaccatttaaccaactaaacgtgcacatgaacccccatcggactccaaaatacttacaaccagcacgacatataaaagcagagcatacgtagatacggagtaaggatctaagcaccaagacatcagaggccttgatgccttctactcaaaagcccactggttctccctgcggatctcctcttcctcctcaggggtgaagtcgttcttgatgttgaaggtcttgcggatctcctcaggagtcttccccttgatcatgtcagcaacagtctggcaagtaaggtccagcaaccccttgatgttgaggtagttcgcggccaggatgaggtcgaagagggtggcctggtcgaccttgacgaagtcggcgtcccagttcttgaggtcctcgccggagggcggcggcacggctgcggcggcggacgcggcgtcgtcggcggccttggaggccgc

SEQ ID NO: 6375 - DNA, 554 bp, Artificial
  Synthetic
aaagagcatagagggcatggcgacgaaggtgaagctccgcagcagcgatggtgagatgttcgaggttgatgaggccgtggcgcttgagtcccagacggtcaagaacatgatcgaggatacggggtcggatgcgccgatacccttgcccaacgtgcccagcaagatcctggccaaggtgatcgagtactcgaagtaccacgtcgacgcgcagaagagcggcggcgacgagtccaagcccaccgaggaggagattaaggcgtgggacgcggagttcgtcaaggtggaccaggcgacgctcttcgacctgatactggcggcgaactacctcaacatcaaaaacctgctggacctgacgtgccagacggttgcggatatgatcaagggcaagacgccggaggagattcgcaagacgttcaacatcaagaacgacttcacgcctgaagaggaggaggaggtgcggagggagaaccagtgggcctttgagtagatcataattatttttataaagtatttgtgttcattaaattattctcaattataaaatttaaatttct

SEQ ID NO: 6376 - DNA, 561 bp, Artificial
  Synthetic
ttttctctctctctctctcgttctctctctctgtgttttctctctctctctctcatcctcgtgatggcgaattcgaggttgaagctgaggtctgcggacgaggagatgttcgaggtggaggaggaggtggggctcgaatcccagaccatccgcaacatggttgaagacatcgggaaggacacaaccatccccctccccaacgtcagtgccaagatccttgccaaggtcatcgagtactgcacgtaccacgtccacgcacgcggtgggagcgccgctggagccagtgggagcgctagcggtggcggtgacgaagccaaggtccccgaggagtctgtcaaggcctgggacgctgagtttgtcaaagtcgaccagagcaccctctttgaccttatcctggcggcgaactatttgaatatcaaaagtctgctggaccttacttgtcagacggtggctgatatgataaaaggaaagacgccagaagagattcgcaaaacgttcaatatcaagaatgatttcactccggaagaggaggaggaagtgaggcgcgaaaaccagtgggcg

SEQ ID NO: 6377 - DNA, 671 bp, Artificial
  Synthetic
ttcgtctcagggttagggtttgtcaatctggtcagcaattcacaattcctctttcctcgaagatgaagatgattgtgctaaggagttccgacggcgagactttcgaggtagaagagtcagttgcccttgagtcgcagacaatcaagcatatgatcgaagacgactgcgccgacaccagcatccctttacctaacgtgacgagcaagatcttagctaaggtgattgagtactgcaagcgccacgtggacgccgcctctaagacagaagataaggccgtcgaggacgatctcaaggctttcgattctgactttgtcaaagttgaccagagtaccctcttcgatctcatcctggctgccaactatttgaacataaagagcttgcttgatctgacatgccagacagttgcagacatgatcaaagggaagaccccggaggagatccgtaagacattcaacattaagaatgacttcactcctgaggaagaggaagaagtcaggagggagaatgcctgggccttcgagtgaatttgagtctgttaagcgtcaatattctgctgatagatttgcaatatcttagtagatgttataaataatcttttatattagtaaatatgtgactgttgtttctgggatctttgaccttgtcagttgaagggagacagttgaacctcg

SEQ ID NO: 6378 - DNA, 712 bp, Artificial
  Synthetic
attatctctctctctctctctctctcaatatatctcaaaaaatctcaattctagggttagtgttgctacgatgtcgtcctctaagatgatcgtattgaagagctcgaacggcgagactttcgaggtggaggaagcggtggctttggaatctcagacgataaagcatatgattgaagatgattgcgccgacaccagcatcccccttcctaatgtgaccagcaagatcttggctaaggttatcgagtattgcaagcgccatgttgatgctaccaaagctgaggataaggcttctgaggatgagcttaaggcctttgattctgattttgttaaagttgaccaggccaccctctttgatctcatcttggctgccaactacttgaacatcaagagcctgcttgatctcacatgtcaaactgtggctgacatgattaaagggaagacaccagaggagatccggaagacctttaacatcaagaatgacttcactccagaggaagaggaggaggttaggagggagaatgcttgggcatttgagtgagctttaaatctcataatctggggataaatttggaatatatcttactagatcgtatgaaaaatcttttgtgttagtaaatatgtgagtacggtatttgctttggatccctgactttgttattcaatgaagtggcttgaacctccttttgctattatgaactcttggtttaatgtg

SEQ ID NO: 6379 - DNA, 553 bp, Artificial
  Synthetic
tgcctctctcctctctctttctggttctttggtttctgagcatataagcagtattcccgccctttttgggggatctaagcctgagccgaagcagaggccatagccgtagccatgtcgagcagtgacagtaaggtgaagctgcggtcctcggatggggagatgttcgaggtcgaggaggcagttgccctagaggcgcagaccatcaagaacatggttgaggacaccggctctgacgcccccatccccctccccaacgttaacagcaagattcttgccaaagtcatcgagtactgcaagttccacgttgacgcccgccggcgcggtgatgatgacaagctccccaccgtctgcgtttccgaggaggaggccaaagcttgggatgcagagttcgttaaagttgaccaggctactctttttgatctcatcctggctgccaactatctgaatataaagaatctgttagacctgacctgccaaactgttgcggacatgataaagggcaagacacctgaagagatccgcaagaccttcaacatcaagaacgacttcacac

SEQ ID NO: 6380 - DNA, 640 bp, Artificial; identical to SEQ ID NO: 4571
  Synthetic

SEQ ID NO: 6381 - DNA, 92 bp, Artificial; identical to SEQ ID NO: 4444
  Synthetic

SEQ ID NO: 6382 - DNA, 634 bp, Artificial
  Synthetic
tttgacaaagaaaggagcaaggaaaaacaagaaacccaatccgctcatcagccctggttcccacctcagcgagacacttacacgagataccctaagcgaatctgtccatccacacccatcatggctgccggaaccaccatcagagtgccgcatctcggcggaatcgatgccggctaccgtctctccaacggtgccgtcgaccccgcaaagcctaccgtcgtactcgtcaactccatgtgcatgacttcagctctgtacgacattcagttcggcaacaaggccctcactgacgttgccaacctgctcgccattgagcctctcggccatggagccactgagacctcggcggagaactacacctactgggacactgccatcatggccgtccaggtcctggatgctctcaacatcaagaaggcttttgcccttggaaccagccaaggaggctggattgtcaccagaatggcccttgtagcccccgagaagatccagggtctcttgctcctgggcacttcgctcgactacgagtccgctgcctcccgtgaaaagggatgctgggatcccgaaactatgctgggtcccgttgtcgacagcctgtacagcactgagccgaccccagatttcctcattgacg

SEQ ID NO: 6383 - DNA, 474 bp, Artificial
  Synthetic
aacagcgggaagcaaaacaattcaatttctacttttcctttcaagtacaacattgtttgtaaaatactccaaaatcaatcgtatcaccaattctatcaactgcatcgccaaatcgccatgcctgagggacgtcaatctcctcctcccgagcgccaatccgccgcccaagtagggaacactggatccggcaaggcctcagatatcagcaagaccagccaaaaggacccaaaatcccagctcgactgtctcacatcgaaccccaagggaccgatggacgatgtgcttaaacacaagttttccagggagcctggaaactgtgagcgctaattagagcgactcgtcttccgcagttcgcgactaatgaattatcatagacactccgttgaacgcttagggagaataaatcgtcatgttgtacaatagtcattcatagcatcaattattgcatcgctatactataacaaaaaaaaaaaa

SEQ ID NO: 6384 - DNA, 996 bp, Artificial
  Synthetic
ctgaatccccaaatcgaagcactcctctcctctcctctcctcagatcggatcgcgagagccccaatcccaccaccgatcgatccattcctgctgctcgcggccaccggagaaggagagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcccacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcatcctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttcact

SEQ ID NO: 6385 - DNA, 651 bp, Artificial; identical to SEQ ID NO: 4883
  Synthetic

SEQ ID NO: 6386 - DNA, 793 bp, Artificial; identical to SEQ ID NO: 4862
  Synthetic
  misc_feature (736)..(736): The residue at this position can be any nucleotide.

SEQ ID NO: 6387 - DNA, 734 bp, Artificial
  Synthetic
gcaatcatcagctacaaagacatctactcatctacacacaaacaaacattcaaaaagcatcatcacacaaagcttccaaagctccagcttctcaacaatccactattctctacacttcaaaccacaacaaccacaaccaaaaccttcaaaatgttcgtcggtgacctcgtccacttccgcgctgctctcagcaacggcatcacccacgagatgattctctgcccctcagccgccacttctcccgccacctccgccgcaaacaccccagacaaccgctccctcgcctcggagaagaagaagaagcgtttctcctctttcttctcccgccctcgcccttctgtcaaggccgccaacgtcggtgctggcatgaagctgcccatgaacattgcctaaataaaaccaatctttcacaccaacaaaacaactacaacaatgtgctcctgaactgcggatataaagaggaatggatgaaccggtctatgcccagcacgatggaataaaatacacaaaacacacaaacacaaaaaacacactcctttaagagacgacgaccaacgaaacaacaacacctaaaagtttttttgctttttccgacactacttttttctttctcttttgtcacaagtttttttgggcatggattttttttacacacagggcaggctgggagcacaaaacagtttttatgagtattagattctatacccatttgattcgagaaaacgcaatgatac

SEQ ID NO: 6388 - DNA, 251 bp, Artificial
  Synthetic
gtgattttgaggcgctgaggaatgacgagagagttgcgtgaaagatgctgtgcttacccatcaaaggacggatcggaatattcacatgtcattgaatgcatttatacaggcacatgtaagtatgcggagaagcccgattgaaagacagcgatctacggaaggagcactgcaagaccccatgcagggacgtaataagaggctatggatacctttataatctaaatttagctcatcaaaatcaacaatcgcat

SEQ ID NO: 6389 - DNA, 688 bp, Artificial
  Synthetic
  misc_feature (444)..(444): The residue at this position can be any nucleotide.
tcttaacgtgtcaatggcctaaaggcgccagtagtatactccgtactggtagtatatcgtggaatcattaggtagctttcctcatacggcctggcgctccctgtaaacgacctgtgaccaaacttcgaacacgagtatcgtcgtagcttcatttcatcgagtttttcagaatttcgaaaacaatcaattcagtttggtgaaggatgacaatgtgtacagaatactacacgccacgtgttgattgcatctacctccgccggcgtctcttgtgcaataactcatcctccacatcgggtttgctagctggcttacactagactgcctttgtataatcatcgcgatacaaatggatcctgcgtgacactgaacacacaattctcaaagaagtgtccccttggcttcccaattcttttttcggactttggccccagacgctggtatatnggatatttctgttcatcccacatctggccattgcttcgatcccctgacgctctgacaaaagaaagacacccaaccctttacgactggctgcgagtagttcgcttggtagcctctcccttggacttgtcagcaccgctggcaacagcctcggacttgtcctttgccttgtccttggaggtggcagcgggcttcttgggggcagcggaagaaccaccaaggccgacaagagcggtgatgatggcaa

SEQ ID NO: 6390 - DNA, 718 bp, Artificial
  Synthetic
aatgtcttgaagtgtaattttcgaagaactatttattatccatcaccagctcgagattgaccgatttctcttacacaaagtacttgcattgctagctctgctggagaaagtaaacaaagtagcacagctaaaatagccctagcagatctcactgccactattgcttctacctgcctatatccattggctttaatactccagtcgcctgcttctcttttccctcctacaatgtccacggctgttgttataaatccgcagtctcacaaccgccctctgccttcagtcggctcacatacacaccgacatatcagcaacagcagcaataacactaccagcaacaacaacaccaaacttgctgcagacacgatgcctcacgctcacgagacgaagcctctctggctcatccagccacgcctcgacgccggcgtgtatcgcgacaagctgatcggcagcgtcgtcaaatacccagaccttcccaccgaacgccacatcccctaccgaacgggcgcaaagctgccccgagacattgtccaagacctcgatcccaagcccatccaggtgcgcaacgtcaagttctggacccgtcgcatcaaagatgccggcgtgtcggcgtcgctcaacgagattctcgaggcctttgtggaccgggccaaggaggacagcagcgagaagatggccacggtagcgaggatatggcacatggattcgccgggcgaga

SEQ ID NO: 6391 - DNA, 763 bp, Artificial; identical to SEQ ID NO: 5081
  Synthetic

SEQ ID NO: 6392 - DNA, 488 bp, Artificial; identical to SEQ ID NO: 5091
  Synthetic

SEQ ID NO: 6393 - DNA, 149 bp, Artificial
  Synthetic
cttgtcattattactcgatcccacgcgtccgtcgacccacgcgtcgcagatacacagcaaacacccaagcaacaacaaaagcaaagcactccagcaacaaacatctacccacctcacaacaacatcaaccaacctgacaacttcttcac

SEQ ID NO: 6394 - DNA, 693 bp, Artificial
  Synthetic
atgcctcgagacagcggcagaaaccgacaaccacgaaccccaaactcgaattcgagcgcaaaccagagcacaggaagagggcaaatgtcgaacccaaacaactggcaggaggaggcgatgcggcgtctgcgccagatgcagacgcggggcgggtatcccggacgaggaggaccgcagatgcccagaggagcaaacggcgccttgattggaggaatcttgctggcgggcggcgcttggttgctgtcgaactcgctgttcaacgtggacggtggtcaccgagcgatcaagtaccagcgattaagaggcgtgagcaaggagatttacagcgaaggaacacacatcaacattccttggttcgagacacccatcatctacgatgtacgagcgaagccgcgcaatgttgcttcgctgactggcaccaaagacttgcagatggtcaacatcacctgccgtgttctgtcaagaccgaatgtcgaagctctgcctcagatttaccgaacacttggaaccgactacgatgagcgagtgctgccatcaattgtgaacgaggtcctgaagagcgtagtcgctcaattcaatgccagtcagctcattacacagcgagagatggttgcccgattagtacgggagaatctgtctcgtcgagctgcgcgattcaatatcctgatcgatgatgtgtctctgacgcatctt

SEQ ID NO: 6395 - DNA, 796 bp, Artificial
  Synthetic
gggagaccatggcctctgtccgatcggctgtgagagcattgccccgcaaaacggcagcaggataccagtccagctattacccctccatccccagacccagatctctgtcttcattttcatctttgtctttgtcttcatctttgcatcgttcgggccctccgtccttttctccgagtcacgcacagagacaccagctagccacgatgtctacgcaagccgcgcacccggccctgctcatcccagggcccattgagtttgacgatgctgtgctccagtccatgagccacttcagcgagtctcatgttggccctggcttcgtggccacctttggcgagactctgagcatgctccgccagctcttccagaccaccgatcctgcctctcagcccttcatcctcagcggttccggcaccttgggttgggatttggtgtctgctaacttgattgagcccggcgaggacgctttggttctaagcaccggctactttggcgacagcttcgccgactgcctggctacctacggagccaagcccaccaagcttgagggaccaattggcggacgaccccagttcccggagatcgaaaaggcattgtcggagaagaagtacaagctcgtcaccgtcacccatgtcgacacctctactggcgttgtgagcgacctgaagggccttgtccaggctgtcaagaaggtctctcccgaaacattggtcgtcgccgatggcgtctgcagtgtagcttgcgaggagattgctttcgacgactggggcttggacggtgtcatcactgcaagccaaaa

SEQ ID NO: 6396 - DNA, 132 bp, Artificial; identical to SEQ ID NO: 4332
  Synthetic

SEQ ID NO: 6397 - DNA, 668 bp, Artificial
  Synthetic
tcagctcacactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttactcc

SEQ ID NO: 6398 - DNA, 742 bp, Artificial; identical to SEQ ID NO: 4339
  Synthetic

SEQ ID NO: 6399 - DNA, 854 bp, Artificial; identical to SEQ ID NO: 4341
  Synthetic

SEQ ID NO: 6400 - DNA, 619 bp, Artificial
  Synthetic
gatctatcaacccgctgctcaaactattaccgggctctccatctgctcttgatacgtcgacacacctcgtaaaactaactccagctcagcaccctcagccgccttcaccatgtcaggctggccgaccactcagcatccgccaggcgttgtttctcaacacgctccgccacctgcatacggctatccacccaaccctgcctttattccagtccaagtgcgacagggctttagtccgtatggtgcacctccgccaccgctatacaacccgtacgcatcaagtccagctcagagccaggcctctactcctggaactacgacaaatgcatctccatcagcacctgtagaacaacctaagggagccaagaccgagtggccagaatcagtccgacgttatgtccagcggtcttttcatcccgaaaacgacgacgcctctgtctctcgcgcggagcttgaggccaagctgaaagacacaatcggcagtgctaaagagaacaactcactctacactattgattgggataacatgcctctgccccaagccttggtgagagctgaccgtgaggcactgcttaagcttcgccatacctcgttgaccacgccgatatatgccgacgactct

SEQ ID NO: 6401 - DNA, 723 bp, Artificial; identical to SEQ ID NO: 5096
  Synthetic

SEQ ID NO: 6402 - DNA, 603 bp, Artificial
  Synthetic
agtagttgcacccattgcccaattgcacaaaagcacacacaatgtcgatcacggcgcaaaacctctcctacaccttccccaatgggcttgtgggcatccatcccacctcgttcgacctgcctcccgggtctagaacgttgctgatcggagccaatggagctggaaagtcgacgttgctgcgaattctggcgggaaagaccctcgccaaggccgacagtctcattgtccagggctttgatcccttccgagactgttctcctcctggaatccggtacctgggcaccgaatgggccggcaatccaatcgtgagacacgacattgaggtcacccagctgctaaagtacgccggaggagatgcctatcctgaccgacgagaccatcttgtgcagctgctggacgtggatcccacctggcacatgcacgaggtgtctgacggagagcgtcggcgagtgcagctagtcatgggactgctggtgccgtgggaaactcttctgctggacgaggtgacggttgatctggacgttctggcccgaactaacctgctcaacttcctcaaggaggagaccgagacccgacaagccaccattgtttacgccacccata

SEQ ID NO: 6403 - DNA, 255 bp, Artificial
  Synthetic
aaagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcat

SEQ ID NO: 6404 - DNA, 683 bp, Artificial
  Synthetic
gtcctcagacgcttgcattaagtagacatcattgtgtctactcccagtcatcgtcgacaacttctttgatacaagattgcaagactctatccaagtatggctaccccaggtaccgaccccatcgagggacaatacaacaaagaatccgcggccgacgtgcccaccaacgggcactatgtttccaatggcatgggctctggacagcaattccagccccagcagtatcagcagtatccgggctatggacaatttgttccgtttagcaacacccaagatcctcgggctgggcctcaccaggccatgatctcccaggtctaccaacctacccttggtaagattggtaacccaggtcctcttggtctgatcggtttcgctttgacgaccttcgtgctcggactttaccagtgcggtgctggtctccctaattccaacccattgggcaacgtcggccctgatcaagctgtcttcggtgtggctgtcttcttcggaggcatggctcagtttgttgctggtgtcatggaatttgtccttggcaataccttcggttgtactctccactgttcatacggggctttctggcttgcctttgccatgttctcagtccctacactgggcatccaggccgcttataacggagatcaacgtgcctttagctttgctgttggcattttcctcatcatatg

SEQ ID NO: 6405 - DNA, 652 bp, Artificial; identical to SEQ ID NO: 4350
  Synthetic

SEQ ID NO: 6406 - DNA, 727 bp, Artificial
  Synthetic
ttgcaagttccattccctgttcttctctctcaacgaagcatcaaccccccttttctcccagaaccgcgtctcatcgcacctgccataaaactccaaaaaatctcaaaaaccaaccgtcaaaatgggtcacgaagatgctgtttatctggccaagctcgccgagcaggccgagcgatatgaggagatggtcgagaacatgaagatcgtcgcctccgaggaccgcgacctgaccgtcgaggagcgcaacctcctctccgtcgcctacaagaacgtcattggtgcccgccgtgcctcttggagaatagtcacttccatcgagcagaaggaggagtctaagggcaactcttcccaggttacccttatcaaggagtaccgccagaagattgaggccgagcttgccaagatctgcgatgacattctcgatgttcttgacaagcacctgattccttctgccaagtctggagagtccaaggtcttctaccacaagatgaagggtgactaccaccgttaccttgccgagttcgccattggcgaccgccgcaaggactccgccgacaagtctctcgaggcttacaaggctgctaccgaggttgcccagaccgagctgcctcctacccaccctatccgcctgggtcttgcgctcaacttctccgtcttctactacgagatcctcaacgcccctgaccaggcttgccacctcgctaagcaggcatttgacgatgctatt

SEQ ID NO: 6407 - DNA, 1160 bp, Artificial
  Synthetic
gtacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctcctcgatgtt

SEQ ID NO: 6408 - DNA, 385 bp, Artificial
  Synthetic
aaccatgacgcgacaagacaacatctacctggctcgtctttccgagcaggccgaccgttacgaatacatggtggactacatgaaggagattgccaccggcgaccaggagctgtctgtggaggagcgaaacctgctctccgtggcatacaagaacgtgattggcgctcaccgagcatggtggcgactggtcagcagctgcgatcagaaggaggagcaaaagggcaaggagaccaagatcatccacgacttccgtcagaagattgatgccggtctgcacgacatttgccatgacattctcaacgtgcttgacaagcacctgatccccaagctcgagaagccctcggccgaggccactgacgctgctgccaaggatggcgccgacccc

SEQ ID NO: 6409 - DNA, 716 bp, Artificial
  Synthetic
aggagcttagatcgatcgacgacgccatcgccgccggagctgccatgggaatggagaaggagagggaatgcttcgtctacatggccaagctcgcggagcaagccgagcgttacgatgaaatggttgaatcgatgaagaaagtcgcgaagctggacgtggagctgaccgtggaggagaggaatctcctgtccgtgggctacaagatcgtgattggggcgcggcgggcgtcgtggcggatcttgtcctcgatcgagcaaaaggaggagagcaaaggcaacgagcagaacgtcaagaggattggagagtaccagcaaaaggtcgaggacgagctctccaagatttgcaatgacattctcacgatcattgacgagcatctagtgccggcttccagcactggcgaatccacggtcttttactacaagatgaaaggtgactactttcgataccttgcagagtttaagaccgggaacgaaagaaaagaagctgccgatcaatcgttcaaggcttaccaggctgcgagcgatactgcttcaagcgatcttcccccaacacatcctatccggctgggactggcattgaatttctctgttttctactacgagattctaaactcgccagaccgcgcttgccagctagcgaagcaagcttttgacgatgcgattgcggagctggacacgctcagcgaagaatcctacaaagacagcaccttgatcatg

SEQ ID NO: 6410 - DNA, 636 bp, Artificial
  Synthetic
ttcgcatctctccatcgccgccgccgccgtttctgccgccgcataggcatccgtcgccaggtagcgcagccgcagccgcagccgccgccgcaaagctaggttgtttctcgccgaaatgccggaatccaaggaggagaatgtctacatggccaagctcgcggagcaggccgagcgctacgacgagatggtggagtacatggagaaggtggccaaggccgtggaggcggaggagctgagcgtggaggagaggaatctcctgtcggtggcgtacaagaatgtgattggggcgcggcgggcttcgtggcggatcatctcgtcgatcgagcagaaggaggagtccaagggcaacgaggagcatgtaggcttgatcaagaactacaggtccaaggtggagacggagctgagcaacatctgccacgggatcttggggctgctggattcgcacctcatcggatcctgctccacgggcgaatccaaggtcttctacctcaagatgaagggcgactacaatcgctaccttgccgagtttaagacggggcaggagaggcaggaggcagccgaggccaccttgatggcctacaagtcggcacaggacattgcgctggcggagcttgctccaactcaccccattcgact

SEQ ID NO: 6411 - DNA, 629 bp, Artificial
  Synthetic
acgcgtcgccctaactaaccctaaccgccaaatattgggggatttatcatttgggtttggatcgagtcagtgcagtctacggtctgcaagcatgtccgggcacgatgagcacgtgttcatggctaagctcgccgaacaggccgagcgctatgaggagatggccgagttcatggagaaggttgctggccatggggacgacctcactgccgaagagcgcaacctcctctctgtcgcctacaagaacgtggtgggtgctagacgtgcctcctggcgcatcatctcctccattgagcagaaggaggagggcaagggcaaccaggaccatgtcagtgccatccgtgactaccgggccaagatcgaggccgagctttgcactatatgtgggggtgtcctcaagatcctggacacgcacctcatcccggccggagaagctgctgagtcgaaggtcttctacctcaagatgaagggtgattaccatcgttacgtggctgaattcaagactggttctgaaaggaaggagtctgctgagaacaccatgtctgcctataagtctgcccaggatattgcccttgcagagcttgcttcaactcatcctattcgcctgggacttgcgctcaatttctcggtat

SEQ ID NO: 6412 - DNA, 696 bp, Artificial
  Synthetic
cacgcgtcgcgacagtcgaaacggggtcccgggaggagagtgtgtacatggccaagctcgcggagcaggccgagcgctacgaggagatggccgagttcatggacgctgtctccaagggcgccggtgctgaggagatgtccgttgaggagcgtaacctcctctctgtcgcctacaagaatgtcattggtgcccgtagagcctcctggcgcattgtctcctccatcgagcagaaggaggagagcaagggcaatgaagaccacgtcgccgccatccgcggctaccgcgtcaaagttgaggctgagctcaccaagatctgccagcgcattctcgacctccttgacagccaccttgtcccctctgcgctcaaccccgagtgcaaggtcttctacctgaagatgaaaggggattaccaccgttaccttgccgagttcaagaccggtgctgaccgcaaggaagcggctgagagtacgctcgtcgcttacaaatctgccgaggaaattgccctggctgagctgccttcgacacaccccattcgtttaggccttgctctgaatttttcagttttttactatgaaattttgaactccccagacagagcttgcaatctagctaagcaggcttttgatgaggccattgctgaactggacactctgggggaagattcctataaggacagtactttgataatgcaacttc

SEQ ID NO: 6413 - DNA, 1043 bp, Artificial
  Synthetic
tcgacccacgcgtccgggcggcagcgcacggcgaggaacaggtgagtgcccgtggatgtgatctagatctaccctccaagccccaaaatctcagtagaaatcctccaaatcgcgccgccggaagagagatccaatccaccactgtccccatttctcggcttgttccagggatgtcgaatcttcgcgaggagaatgtctacatggccaagctcgcggagcaggccgagcgctacgacgagatggtggaattcatggagaaggtggtcaaggccgtggacgtggaggagctgacggtcgaggagcggaatctcctgtcggtggcctacaagaacgtgatcggcgcccgccgggcatcgtggaggataatctcctccatcgagcaaaaggaggaatccaagggcaacgacgaccacgtctcgatgatcaaggagtaccgtgccaaggtggagtcggagctgagcaccatttgcgacagcatcctcaagctgctggacagccatctcatcccctcatcgtccagtggcgagtccaaggtcttctacttgaagatgaagggtgactaccaccgatacttggccgagtttaagaccggggccgagaggaaagaggccgcggagaacactctcctcgcctacaagtcggcccaggacatcgctctcacacagctgccgccgacgcatcccatccggctgggtctcgctctcaatttttcggtcttctactacgagattttgaattcgcccgatcgagcttgtacgcttgccaagcaggcatttgacgaggccatagccgagctggacactttgggagaggaatcttacaaggatagtactctgatcatgcagctgctgcgcgataatctaacgctgtggacctcagacatgcaggaggaaggtgccggcgaggggaaggacgacaagccgtgagtaaaataatacgttcgaatttcgttttctatgctactagctagctgtttagacgccttctctctcaacaccttggtactgttgattctttcgttcctgaatacattatttggcttg

SEQ ID NO: 6414 - DNA, 500 bp, Artificial
  Synthetic
ccaaaatttccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtacctt

SEQ ID NO: 6415 - DNA, 873 bp, Artificial
  Synthetic
aaatcctgaattgcaccaactagtacaacgacaacaatgtcttctgagagagaaaccaagaccttccttgcccggctctgtgagcaggctgaccgatacgacgagatggtcaactacatgaaggacgtcgctaagtccggtgaggagcttactgtcgacgagcgaaatctggtttccgtcgcttacaagaacgttatcggcgctcgacgagccagctggagagtcattttccccatagagcagaaggaggaggccaagggtggcacccaccatctcgagcttctcaagacctacagagcccagattgagggagagctcgaagacatctggagcgatgttcttgatattctcaacaaacaactcctccccaaaggcgagaacgccgagtctaaggtcttctactacaagatgaagggtgactaccatcgataccttgccgagttcacctccggcgagaagcgaaaagaggctgccactgccgctcacgagtcatacaagagcgccactgatgttgcccagactgagctcagctcaactcaccccatccgacttggtctcgctctcaacttctccgtcttctactacgagattctcaactcgccagaccgtgcttgccaccttgccaagcaggctttcgatgatgccatcgctgagctcgacactctctccgaggagtctttccgagactctaccgtcattatgcagcttctgcgagacaacctgaccctctggaagaacgacctcgaagagtctctgcaagcccagcagtctgaggagacccctgccaccgatgctgccgctgcttccaccgaggctgctgcccccaaggaggaggccaagcccgctgctgaggagcccaaggagtagagtagt

SEQ ID NO: 6416 - DNA, 953 bp, Artificial
  Synthetic
gaatttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttata

SEQ ID NO: 6417 - DNA, 578 bp, Artificial
  Synthetic
aaaaaatcagagaagtgaagagaagagatcaagggatcgatccttgagaaggcaatgggaatcgagaaggaacgtgagaccctcgtctacctctctaagctcgctgagcaagctgagcgctatgacgaaatggtggagtcaatgaagaaagtggctaagttggacattgagttgagtgtggaggaaagaaatctgctctccgttggatacaagaatgtgatcggagcacgcagggcctcctggcgcatcctctcttccattgagcagaaggaagagagcaagggcaatgagacaaatgtgaagcgcattaaggactatcgcttcaaggtggaggaagagctctccaagatatgcagcgacatcctaaccatcatcgatgagcacctcatcccctcatccaacaccgctgaatccactgttttctattacaaaatgaaaggggattattatcgataccttgcggagttcaagtctgggcatgagaggaaggaggctgccgatcaatctctgaaagcttatcaggcggctagtaacactgcgaacacggatctaccatccacccacccaatcaggcttgg

SEQ ID NO: 6418 - DNA, 626 bp, Artificial
  Synthetic
tcttgttttttgttttggttgttgacggaagaagaggagggagaaggcatgggtgtggagaaggatcgcgatggccatatctacatggccaagctcgctgagcaggccgaacgatacgatgagatggtcgattttatgaaaaaggtggcaaacatggatgtggagctcactgtggaggagcggaatcttttatcagtaggctacaaaaatgtgattggggcccgcagggcttcgtggcgtattctctcctcaattgagcaaaaggaggaagccaaaggcaatgagcagaatgtggggcgtatcaaagactacaaggaaaaggttgaggaagagctctcaaagatctgcattgacatcttgtcgactatcgatgatcatcttatccctgcatccagcactgacgagtcttctgtgttttattacaaaatgaaaggggattacttccgctatttagcagagttcaaagcctcaagcgagaaaaaagatgctgcagagcagtctctgaaagcataccaggttgcagcagataaagcagccaagagtcttccaacaactaatccgatcaggcttgggcttgctttgaacttttcagttttctactatgaaatcatgaactcccctgaaaa

SEQ ID NO: 6419 - DNA, 1103 bp, Artificial
  Synthetic
caaaagtccaaaatttcccccacaaaagctctcctctctgaattattaaatccccattcagaaaatcgaaaaactccctcattcagatctcccaaaaaaatacagagaaacaaatctaaacatggcggtggcaccgacggcgcgtgaggagaacgtgtacatggcaaagcttgcagagcaagctgagaggtacgaagaaatggttgaattcatggaaaaggtctccaactccctcggctcagaagaactcaccgtggaggaacgaaacctcctttccgtggcgtacaagaacgtgatcggagcgcgtagggcatcgtggcgtattatctcatcgattgagcaaaaggaagagtccagagggaacgaggaacacgtgaactctatccgcgagtacagatctaagattgagaatgagctctctaagatctgtgatggtattctgaaattgctcgatgcaaagcttatcccttctgcagcatctggtgattctaaggtgttttacctgaaaatgaaaggagattaccaccgctatttggctgagttcaagaccggtgctgaacgtaaggaggctgctgagagtacactcactgcctacaaagctgctcaggacattgcaactactgaacttgccccaacacatcccatccgacttggactggctcttaacttctctgtgttttactatgagatcttgaactctcctgaccgtgcttgcaatcttgctaaacaggcctttgatgaagcaattgctgagctggatacattgggcgaggagtcttacaaggatagcactttgatcatgcaacttcttcgtgacaatctcactctctggacttctgatatgcaggatgatggggctgatgaaatcaaggaagatcccaaacctgatgaagccaaaaattgaaggaaatgaaactctctaatttgcttttcacttcttcctggttgtttttattggaagaagctgattatcgtaatttccttactattatggttctccactagggggttgtcatcttattggaaatgaacaacttttaatattgatgtttcagagttccatctttgatttaatgtggttttctggtgattagttttcttct

SEQ ID NO: 6420 - DNA, 451 bp, Artificial
  Synthetic
ccccccccccccggaaaaatcgttgggggagtaagaacatttgacagcgccccaaaaccaaaaaagaaaaagggggaaaaattcttctctttttcaacacacagaaaaaaatcttccgaaagagagagagagatcagaaaatgggtgaacgtgagaacttcggatacatcgctaagcttgccgagcaagctgaacgctatgatgagatggttgatgcgatgaagaatcttgcaaatatggatgttgaattgacagcggaagagaggaatttgttttctgttggttataagaatgtggttggagctaggagagcatcgtggaggatcttgtcttccatcgagcagaaggaagagtctagaggaaatgagcagaacgtgaagcggattaaggagtaccagcaaaaagtggagtcagagctcaccgacatttgcaataatatcatgaccgcgat

SEQ ID NO: 6421 - DNA, 598 bp, Artificial
  Synthetic
cggacgcgtgggcccaaagagagagagcgagagagagagcggagaaatggagaaggaaagagagaaacaggtttacttggcaaggctagctgagcaagctgagagatatgatgaaatggtagaagcaatgaagacggttgctaagatggatgttgaactgactgttgaggagaggaatttggtgtcagttgggtataagaatgttattggagcaagaagggcttcatggcggatattgtcttcaattgaacaaaaggaggagagtaagggtcatgaccagaatgttacgagaataaagacttaccaacagagggtcgaagatgagcttacaaaaatatgcattgacattttgtcggtgatcgatgagcaccttgttccttcttccactaccggagaatctactgtcttctactataagatgaagggagattactatcgctatttagcagagttcaaatcaggggatgatcgtaaagaggcagctgatcagtcacttaaagcttatgaggctgctacttccacagctagtgcagatcttgctcctactcatccaattagacttggacttgcattgaacttctcagtcttctactatgag

SEQ ID NO: 6422 - DNA, 988 bp, Artificial
  Synthetic
gaacaatgggtgccgagaaggagagggagggtcatgtctacctggccaagcttgcagagcaggctgagcgttacgatgagatggtcgagttcatgaagaaggtagccaagcttgacattgagctgactgtggaggagcgcaatcttctctcagtggcctataagaatgtgattggagcacgtagggcctcttggcgtattctctcctccattgagcagaaggaggagagcaaagggaatgaggttaacgtgaagcgtataaaggattacaggcaaaaggtcgatgaggaactctcgaagatctgccatgacattttgactatcatagatgagcatctcatcccctcttctgggactggcgaatcgtctgtcttctactacaaaatgaagggagattactaccgctacctcgcagagttcaaagctggtccgcagaaaaaggaagacgcagatgagtccttcaaagcctaccaagctgcgtcgagcaccgcgagtactgatctgccacctacccatcccatcaggcttggactcgccttgaatttctccgttttctactatgaaattttgaattcgcccgagcaggcatgccaattagcaaaacaagcattcgatgaggcgattgcagagctcgatactctgagcgaggagtcatacaaggacagcacccttattatgcagcttctaagagacaacctgaccttgtggacttcagatctgcaagaagatggaggtgatgagcactccaagggagaggatctgaaagtaggagatgcagaggaatcgtagtgccagtttgattgttcgagctgagttttgaaggagtcgagccggatatgcatccttggtacaaaatttgacatgtgttagattctgtgtggcatttgtttgaaggaatatcctatgtagattgttatgttcttgttctgctctattgctacaagggctgttgttacaattacaagttatacattttctatttgagggaa

SEQ ID NO: 6423 - DNA, 565 bp, Artificial
  Synthetic
gggtttggatcgagtcagtgcagtctacggtctgcaagcatgtccgggcacgatgagcacgtgttcatggctaagctcgccgaacaggccgagcgctatgaggagatggccgagttcatggagaaggttgctggccatggggacgacctcactgccgaagagcgcaacctcctctctgtcgcctacaagaacgtggtgggtgctagacgtgcctcctggcgcatcatctcctccattgagcagaaggaggagggcaagggcaaccaggaccatgtcagtgccatccgtgactaccgggccaagatcgaggccgagctttgcactatatgtgggggtgtcctcaagatcctggacacgcacctcatcccggccggagaagctgctgagtcgaaggtcttctacctcaagatgaagggtgattaccatcgttacgtggctgaattcaagactggttctgaaaggaaggagtctgctgagaacaccatgtctgcctataagtctgcccaggatattgcccttgcagagcttgcttcaactcatcctattcgcctgggacttgcgctca

SEQ ID NO: 6424 - DNA, 659 bp, Artificial
  Synthetic
acctctaagccttgcagataacccgtcttgttcatctctctttctctctctctctctctcatcttctctagctctctctctgtgtgtcccctgtttccctgtcttagaccatgactccgtcgatggaggggggcaagcgggaggagaatgtgtacatggcgaagcttgcggagcaggccgagcggtacgaggagatggcggagttcatggatgccgtcgtcaaggacggtgctgacgagatgtcggtggaggagcggaacctcctctccgtcgcgtacaagaacgtgattggcgcgcgtcgcgcctcctggcgcatcgtctcctccattgagcagcgcgaggagagcaagggcaaccaggagcacgtctctgccatccgcgactaccgtgcctccgtcgaaaccgagctcaccaagatctgcaaaagcatccttagcctcctcgagatgcaccttgtcccttccgccaccacccccgaatccaaagtcttctacctcaaaatgaagggcgactaccaccgctaccttgcggagttcaaaatcggggcggaccgcaaaaaactggcgataaatactctcaccgcctacaaatctgctcaggaaatagccttggctgagctgccttcaacacaccccattcgtttggggcttgctctaaat

SEQ ID NO: 6425 - DNA, 627 bp, Artificial
  Synthetic
aaaaatctcataaacgaaacacaaaaaaaaaaccctctctcgaaaattaaaaataaaaaatacccggcgaatctccgacgatggctttgccggaaaatttaaccagagagcagtgcctatacttagcaaagctcgccgagcaagccgagcgttacgaggagatggtaaaattcatggaccgactcgtagctgtctcggcttcctctgaactaaccgtagaagagcgaaacctcctctcggtagcttataagaacgtcatcggttcacttcgagccgcgtggaggatagtatcgtcaattgagcaaaaggaagaaggtaggaagaacgaggaacacgtggttctagtgaaggattatagatctaaggttgaatctgagcttagtgatgtatgtgctggaattttgaagattttggatcagtatttgattccttcggcttcggctggtgaatcgaaggtgttttacttgaagatgaagggagattattatcgttatttggctgaatttaaagttagtaatgaacgtaaggaggctgctgaggccactatgcttgcctacaaagctgctcaggacattgcgcttgctgagcttgccccaacacatcctatacgacttgggctagctctca

SEQ ID NO: 6426 - DNA, 708 bp, Artificial
  Synthetic
acgcactctgtcgagaatccattctatttcgcctaaactttctctctctacaacaacaacaatggcggctctgctcacagacaatctcaaccgcgaacaatacctctacttagccaaactcgccgaacaagccgaacgctatgaagaaatggtccagtacatggacaaactagtactcagttccactcccgccgccgaactcaccgtcgaggaacgaaacctcctttccgtcgcttacaaaaacgtgatcggctctcttcgtgccgcgtggcgtatcgtatcctccattgagcagaaagaggaatcgcgtaagaacgaagaacacgtttcgctcgttaaggagtacagaggtaaagttgagaatgagttaacggaggtttgtgctggtatcctcaagttgcttgagtcaaatctcgagccgtctgcttctacgggtgaatcgagggtgttttacctcaaaatgaaaggtgattattaccggtatctagcggagtttaaggttggagatgagcggaagcaggctgctgaagacactatgaattcttataaggctgctcaggaaattgcactagcagatctgcctccaacacatcctataaggctgggtcttgcacttaatttctcagtcttctactttgagattctgaactcatctgacaaagcttgtagtatggcaaaacagggcttttgaggaagccatagctgagc

SEQ ID NO: 6427 - DNA, 1132 bp, Artificial
  Synthetic
agccaagtgaaagcaaaaagggagaggaaaagcgcaaaatctcccttcgattatcagtacaaaacctctgatttgagagatcggaaatggcttcctccaaagaacgcgagaacttcgtctacgtcgctaagcttgctgagcaggccgaacgctacaatgaaatggttgatgcaatgaagagtgtagcaaatatggatgttgaattgactgttgaggaaaggaatctgctttctgttggttataaaaatgtggtaggttctaggagagcatcttggaggatcttatcctctattgagcagaaggaagaatctagaggaaatgagcaaaatgtcaagcgaattaaggagtaccgacaaaaggtggagacagagctcaccagcatttgcaacgatatcatggtggtcattgatcagcatctaattccttcatgcactgcaggcgaatcaactgtgttttaccacaagatgaagggagactattatcgttatcttgcagaatttaaatctggcaatgacaagaaagaggttgcagagctttcattgaaagcatatcagtcagctacaactgctgcagaggcggaattaccacccactcatcccattcggttgggattggctttgaatttctctgtgttctattatgagatcatgaattcacctgaaagggcatgccatctggcaaagcaggcctttgatgaagcaatatctgagttggatagcctgaacgaggattcctacaaagacagcaccttgattatgcagcttctaagggacaatctcaccttgtggacttctgatcttccagaggatgcagaagatgcccaaaagggagatgccacaaacaaagcaagtggaggtgaagatgcagagtgaatgggcctaatggttagaactaccttgtgcatttggagctgtgaggacggtgatacaccaaagggatgtgtgtgtgttaagtcctagtagattcttatcttatgggcatgtcgtgtcagtttctttacatgttaattgggtgttgcaattcagcatgtgtgtgatttgtatccctgtgctatttcctctccgtaaagtgagttgtttcagtctttagatgattggtctggtccataggtggttttatttttcagaggact

SEQ ID NO: 6428 - DNA, 617 bp, Artificial
  Synthetic
cggccgaacaaaaagcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggc

SEQ ID NO: 6429 - DNA, 1002 bp, Artificial
  Synthetic
ccccccgagatctcaaaaattcaacattggcacaaccaaaaagaaaagagatccctaaattggaattcattatggcgcgtgaggagaacgtgtacatggcgaagcttgccgagcaagccgagagatacgaggaaatggtgtcgttcatggagaaagtctctacttccttagggacgtcagaggaactcacggtagaggagagaaatctcctctcggtggcgtacaaaaatgttatcggggctcgtagagcctcgtggcgtataatctcctccatcgaacagaaggaggagtcgaggggaaacgaggaccatgtgaaatgcattcaggagtacagatctaagattgaatctgaactctctagtatctgtgatggcattctcaagctccttgattcttgtcttattccttctgcttcagctggtgattctaaggtgttttaccttaaaatgaagggtgattatcatcgttatttggctgagtttaagactggtgctgaacgtaaggaagccgctgagagtactctctccgcctacaaagccgctcaggatattgcaaatgctgaacttgccccaactcacccaatccgacttggactggctctcaacttctctgtgttttattatgagattttgaactctcctgatcgtgcctgcaatcttgctaaacaggcctttgacgaagcaattgctgaattggacacactgggagaggagtcttacaaggatagcactttgatcatgcaactgcttcgtgacaatcttactctctggacctctgatatgcaggatgatggcgctgatgaaatcaaggaaaccaaagctgacaatgaacaacagtgaggaaactgcccctcatattgtcttttgacttcttcctgttggtttttattgggagaagctgtttccttttatttcctttttaatgtggtttcccttcagcgttctcttatccgtcgcaataacaactttgacaattgatgttcaatgattttatctttatttt

SEQ ID NO: 6430 - DNA, 403 bp, Artificial
  Synthetic
cggacgcgtgggaaaaaaatcaaatctctctctttctctctctaatggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagc

SEQ ID NO: 6431 - DNA, 411 bp, Artificial; identical to SEQ ID NO: 5104
  Synthetic

SEQ ID NO: 6432 - DNA, 737 bp, Artificial
  Synthetic
tcgacccacgcgtccgcaaccaacagccaaggcgttgaaaagagcatcacatgaaaatttgcagagaactgcttcgcgacacattacgttgccaaaaacgtacttcgacgctcacatcttcaagacgtctcactgcaacgcccagccgcaaaatggcattctcccagcgtcacttttacacccccgagacatccttcactcccctcttccgccttcttgatgactttgacaattattctcgtccaggcaacgcggagcaacagggtcgtcgctctggcctagcgcactggcaaccgaaatttgacatgcgcgagactgactccgcgtatgagctccatggcgagctacccggcatgagcaaggagaatgtgaacgttgaattcaccgatcctcaaaatatgctcgtaagcggtaaaattgagaggacatacacttctggtaccccacctgctggagccctggagggaattgcatcgagaggcaagatcgccgagggcggcgaaggacaggccaagacatcttcccgcgaagcaaccgccaaagatgcgactgaagatacagccaagtactggctcactgagcgcagtgttggcgagttctcgcgcaacttcagtttccctacgcgtatcaaccaagaaaacgtgacagcgagttttaaggatggcatcctcaacattactgttcccaaggctgccaaacatgagtcacgccgcattaccgtcaactaattgacgttt

SEQ ID NO: 6433 - DNA, 555 bp, Artificial
  Synthetic
cggtctcctcagctgcttgcgccaagacgagtcgcggctcaacagggggaggggcggcgatctccatccatccggcgagcagagcaggggaggggaggggatcctggaaaatgctaaaccttattaagataaagggtcaaaagaaggaagatgcagccaatgcaaatggaaagcctcctgccaaaaagcaaagtccaggggagttgcgtcttcacaaagatattgctgaacttaaccttcctaagtcgactagaatttcttttcctaatggcaaggatgatttgatgaactttgaagttactattcgacctgatgagggatactatgtaggtggtaaatttatttttactttccaagttcctcctgcctatcctcatgaaccacccaaagtcaagtgcaagactaaggtctatcatcccaatattgacttggagggaaatgtctgccttaacattctgcgtgaagattggaagcctgtcctgaatgtcaacacgattgtatatggcttgaatcttcttttctcacaacctaatgatgaggaccctctaaatcatg

SEQ ID NO: 6434 - DNA, 614 bp, Artificial
  Synthetic
ggcaacgagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatgaaaaaaaagcaaaaggaggctgaaaatgccgaaggtcaggctgctggagggaagaggaagaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaattcacattcgactttgccatcaaccagaacttcccgcacgagcctcctaaggtgctgtgcagggagaagatatatcatcccaacattgatctcgagggcaaggtctgccttaacattctgcgggaggactggaagccggtgttgaacttgaatgctgtcattgtgggg

SEQ ID NO: 6435 - DNA, 1304 bp, Artificial
  Synthetic
atcaacactcgacttgaacacatacaacagccaatcacctctttacatcctcactcaaacaatcaacaaacaaaccaacacaaaaactcaaccatctaatctacatttttaaataaaaaccctcacacgaccatcctcaaacagctccaatacacacttccgaggagaaccagtcatctgctaccgatcggcccataactcgctgcctcttgctgctttgggatccaccacagcttttctgacaccacccctctcccatctgagttcctctggggtatcaaatctcgcccgactacctagaaccaggcctttttttctccttaaacagccccgacagccatcacagttaccgctcgagccggccttaatcagcctacttcaactggagagatagccttttcgcggccttttcgcaaccccgctttccgcacagtagaaaccagaagcttcgaagctctcgagatatatattcgctactgagccacatccctccactctagcttcccatagctatcaccaccgcactcccctacacaaccaacccccaacagtcatcatgaaggtcgtcaccaaagaagaagaagccgcccactacggcgctgtcgtcaagggcggactcattggtggtactcttggtcttgccattggtgtctctggtgttgtctacgcctcaaggcgctaccccagcttccgtggcttgacactccccttccgaactttcctcgtcacatccaccgccacctttggagccattgtccaggctgatcgagctggcatcaagttccagcagggcaaggaccccatgaagacctaccgcgatgcctctcagcgtgctcaggaggttatccgtgagaacgagactgcatacgagcgattcatgaactatggacgcgagcaccgctacagcattgtctgcgcctcatggcttgctagtttggccgttgcctttgccattgtcagccgcgcgcctatgagcacaccccagaagatcgtgcaggctcgtgtctacgctcagggcctgactcttgctgtgctcatcgtctcagctgcctttgagatgaacgacgccaagaacgcaaagggccgctgggagaccgtcatggtcctcgaccccaacgaccccgagcacaagcacctcattgagaagagaatccaccacgaggagtacgagggacaagatctgtggatggatatggttgaggctgaggagaagagaatggctgcccgcaaagctgagcaggagcgcgagcagcagcaggcccagtaagcaagctgctgaatgcatttcattctcccgcccatgt

SEQ ID NO: 6436 - DNA, 476 bp, Artificial
  Synthetic
ccccccccagaaacccctccttttcttttccccttcctgggggggtctagggttttgcctcccagcggcgactgggggagcgagaccaccggcaagctcgtcggcgatggaccccacctcgtcggcggcgatggcgaggcacacgtgggagctggagaacaacatcccggggggggcctccgacccggacgccctggacgcgatctaccgttacgacgaggcggcgcaggcgcgggtgcaacaggagaagccctgggcgaacgacccccacccctttcgccgcgccaagatctccgccctcgcgctcctcaagatggtcgtccacgcccgcgccgggggcactatcgaggtcatgggcctcatgcagggcaagtgcgagggcgacgccatggtggtcatggacgccttcgcgctccccgtcgagggcaccgagaccagggtcaacgcccaggccgacgcctacgagtatatgggcg

SEQ ID NO: 6437 - DNA, 615 bp, Artificial
  Synthetic
gcagcatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagaggcttaaccaacagcatcaggagccatttttagctgttgttattgatcccacaaggactgtttcagctggtaaggttgagattggtgctttcagaacatactctaaaggatataagcctccagacgaacctg

SEQ ID NO: 6438 - DNA, 615 bp, Artificial
  Synthetic
gcagcatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatg

SEQ ID NO: 6439 - DNA, 612 bp, Artificial
  Synthetic
tgtcaaagtccgcagttccctttacgaaatcaaccattcgccgtgcttcgtccagctaattgaccccgtctagatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggttcggcgccggctactgggccttcatggccaccggcttcttcgctccctttggcattgccgtctaccaaacctacaagacccagtaaacggatgcttcgattacaaaaggcttatatgggctggacgcttggtgctatgaatgggtggtggactgttgcgacagagtaaatagctcgaattagacgtgggaccaattcacaagtcacatacatcacaaaacttgttctgtgccggctccattttgcattcacccttggaactaccatatggatatgattcaaacttgtcataaaatcattgctgcattccatgatgatccccatcgacgtaggatagggctagtctatatgtttggcaaatgttatctaacgtacatgaacacttaaaaaaaaaaaag

SEQ ID NO: 6440 - DNA, 573 bp, Artificial; identical to SEQ ID NO: 4356
  Synthetic

SEQ ID NO: 6441 - DNA, 649 bp, Artificial
  Synthetic
tctctcccctctgcggcatcttcaccatggctgaaccaacccccggcctcactcccgagcagctctcggccttccaaaaagacggctatctcatcatccgcaacgccctcaagccagaaaccgtctcatcgctccttagcgaaacaaagggcctgctcgagggcttctccctcaaggaccacccgctgactcgcttctccacgggcgagaagtcggaccacgtgggcgacgactacttcctcacgtcgggcgacaagatccgcttcttcttcgaggaggacgcctttgacgacgcgggcaacctgaccaagcccaaggagcgcgccgtcaacaaaatcggacacggcctgcacgtgcactcgccgccgtttgcgcggctcattgacgaggcgtcgacgcgggccgcgggcgaagtgagtcctgcggctgtggctcgtgatctcgggttcaaggatgcgcggtgtctgcagagcatggtgatttgcaagcagcccgagatcgggggcgcggtgccgccgcaccaggactcgacgtttttgtacacgagcgcgccgtcggccgtgggcttctggtatgcgctggaggacgcgacgctggagaatgggtgcttgagtttcttgccggggtcgcatcgctgggcgcccgtgga

SEQ ID NO: 6442 - DNA, 428 bp, Artificial; identical to SEQ ID NO: 941
  Synthetic

SEQ ID NO: 6443 - DNA, 600 bp, Artificial
  Synthetic
cgtcgcttcatctagaatagccatatagaacttttgtttactgtgtgcgccgtatctgtgcaccctgcagccatcatgaagctctcaaatgccgtggcctttagcctcgtctccctgccaggggccatggcttggggaggtctgggccacatcacgactgcctacatagcaagccagtttgtcagcaactccacagaggcctacctcaagcaccttctgcgaagcaatgagcccgactacatggccaaggtagccagctgggccgactcgatccgatacacaaaatggggcagattcacgagcacgttccatttcatcgatgcccacgatagcccgcccgagtcgtgcaacgtcgactttgagcgcgactgcaaggggaccggctgtgtcatcaccgccctagccaactacaccgagcagtctctcgacccgtcgctgccgccatggcaacgtgcccaggctgccaagtttgtcattcactttgtcggcgacttgcaccagccattgcataacgaaaatgttgcgaggggcggaaatggtatccacgtcaagtggaatggacgagactttaacctgcatcacgtctgggatagctccatt

SEQ ID NO: 6444 - DNA, 486 bp, Artificial
  Synthetic
accccatcatctgcttcacatattcattatgggggcatctgtcgagcaccaaaatggctcccccgattcacttcatcaccggcaatgcgaataagctgagagaagtcaaagcgatcctcgagccgcaaattgagattgacagccagtcgctggatctcgaggaaatccaaggaacgattgaagaggttgccgagtcaaaatgtcgtcgatctgccgacttggtaaacggcccggtgctggttgaacacacggcgctctgttttaatgctctcggaggcctacctgggccttacatcaaatggttcctggataagactgggcaccaaggtctcaacaaacttcttgcggcatacgaagatcaatctgcagaagcagttggtacatttgcatactcaccacgacctggccgcgacccaatcatcttccaaggacggacgccgggtcccattgtacctgcgcgaggcccttcgaactttggctgggacc

SEQ ID NO: 6445 - DNA, 545 bp, Artificial
  Synthetic
cccacgcgtccgaatggcgctagtgagggcggaggtggtgctcaagaagcccgtcaccttcgtcacgggcaatgccaagaagctcgaggaggtgaagatgatcctcggcaattccattcctttctcgacgctgcgaatagattgtagatttgtattaaatagttttgtattctttttataatttttgtatagtgccggagcttcaaggtgagcccgaggagatctccaaggaaaaagctcgcattgctgccaagcagattgatggagcagtgctcgtcgaggatacatgcttgtgtttcaatgccctgcatggccttccagggccttatgtgtaagcttggaacaaacttcattatagaaaatgcttgtgtcgttgcaggaagtggtttcttcaaaagcttggccatggaggcctcaacaacatgcttgcagcgtacaaagataaatcagcctatgcactctgcgtcttctctctagctcttggacctgactcggaaccgataacgtttgttggacgcaccgaggggaagatcgttccagcgaga

SEQ ID NO: 6446 - DNA, 605 bp, Artificial
  Synthetic
ccccccccggctgggctaatcaatctcttccgccggtccgccgcatcaccgttcctcccggcggaagcagcggccaacaccggagcgcagcaagcatgtccggggcggcggcgcgggcgctgcccaaggcggtgaccttcgtgacgggcaacgccaagaagctggaggaagtccgcgccatcctcggctcctccatccccttccagtccctcaagctcgacctccctgaattgcaaggtgagccggaggacatatctaaagagaaagcacgaatggctgcatcccaggtgaatgggcctgtccttgttgaggacacctgcctatgcttcaatgcactcaaaggcttaccagggccctacataaaatggttccttgagaaaactgggcatgaaggtttgaacaatttgttgctagcctatgaagataaatctgcttttgctatgtgcatcttttctcttgctcttggaccaggagaagaaccaatgacattcgttgggaaaacagcaggaaagattgtgcctgctagaggacctgctgattttggatgggacccagtattccaaccagatggttttgatcaaacctacgctgagatgcccaagtca

SEQ ID NO: 6447 - DNA, 641 bp, Artificial
  Synthetic
aacttcccatatccgcacagacaaatctcacacaatgtctaccgccgagctcgcatcttcctacgcggccctgatccttgccgacgatggcattgagatcaccgccgacaagctccagaccctgatcgccgccgccaaggtcgaggttgagcccatctggacatcaatcttcgccaaggctcttgagggcaaggacattaaggacctcctggtcaacgtcggctccggtggtggtgccgccgctgcccctggcgctgccgccgctgctggcggtgccgtcgctgacgctcctgctgaggaggcaaaggaggaggagaaggaggagtccgacgaggacatgggtttcggtctcttcgactaaacggccagctccacctgttgcggcgactgttttttctcttgcttctttgtacttcaactgcatggcacttcggggtctttatacacatcgatggatgcatacaggatggagtgggcgcctatatcctgcgtcctgggcagagtagcttcgttcataaggataatatgatgaatgctctcacacgacggagttcacgcggggaggggacaaatagtcaattaaatgacttgggaagaacaaaaagaaattttttgacaaatgttgaacttttgaaaaaaaa

SEQ ID NO: 6448 - DNA, 344 bp, Artificial
  Synthetic
ggggggagaagaaaagccagaagatgcgagggggccgtgagtttgagtgtgagtattgcggcgttgtccaggtacaacgggggggacgaaatgcgaaaagcgcacaagacaaggtaaaggaaacggctaaaagaacagacagggcgtgaggataggaaaaggaaacaaaaacgaagagattcccagtattaaatgaaacgaatatgcgccgtagagtagagaggcaccagagcagacttcgagagtcgctggcgagcttacaatgcggtaccgaacttcatcgcgacgttcgatggggaaagaagagcagaatcgatgacggccatgggggtcgtggcatagct

SEQ ID NO: 6449 - DNA, 578 bp, Artificial; identical to SEQ ID NO: 4363
  Synthetic

SEQ ID NO: 6450 - DNA, 670 bp, Artificial
  Synthetic
  misc_feature (57)..(57): The residue at this position can be any nucleotide.
  misc_feature (205)..(205): The residue at this position can be any nucleotide.
cacccttagaaaaagacacagacagacacatccaccatgtccaaggaatccggcgtntcactcccacggagaagggcgacaatgtcgtcgactaccaggccagcaccgtggtcaacaccaaggagggccttgagtgtcgaccccaactggttcacccgcaacggtctcaatgccgactccttcaagaagaagcactatgtttaangcatggtggagctcgagcgtcccatgaaagctcgccatctgcacatgattgccattggtggttccattggtgctggtttcttcgtcggttcgggtggtgctctcagcagaggtggccctggttctctcttcattgatttcctcatcatcggtatcatgatgttcaacgtcgtgtatgctctcggtgaactcgccatcatgtatcccgtctctggttctttctacacatactctgctcgtttcatcgatcctgcctggggtttcgccatgggctggaactatgttcttcagtgggctgccgttcttccgcttgagttgaccgtctgtggtattacgatttcgtattggaatgccaacatctcgactgccgtgtggatcaccatcttcctcgtcgccatcatcatcatcaacctgtttggtgctctgggttacgccgaagaggagttttgggcatcttgcttcaagc

SEQ ID NO: 6451 - DNA, 661 bp, Artificial
  Synthetic
acctctcaccctcttcatcacttccaccactcttgtgtgaacgtgtgaaccctcgccaaaatgactaccaaagtcgaacacgaccaccacggtcaccacactatggacgagaagcacatcgatggctctccaggttatacacacgataagcccgacccggagcaccctggcactgctccagttgtcgcctctaatgagctgcacaagagcctgaagggcagacacatgcagatgattgctattggtggtgcgatcggtgctggtctgttcatcaactctggaagcgctttccagaccggtggtccagccagtgttgtcctcggtttcctcattgtcggtataatgatctacttgatgatgcaagctcttgcagagttggctgtcatgtacccaattaacggcgcattcaccatgtacatttgccgcttcgttgatccatcctggggtttcgcctgtggttggcaatacgctctctcctggttgactgtcctgccattcgagatttcagccgcctgcaacattatccacttctggcccggttctgaaggaatcaacaactctgcctggattgttccccttcttgttgcgctcgttggtattcagtacttcggcgtcaagggttacggagaggttgagttcgttctttctctcatgaagatta

SEQ ID NO: 6452 - DNA, 465 bp, Artificial
  Synthetic
aagagctctcccttcacctcaggttgttaaagcttgatctgagtattcagaaacactagccaagatgcagaacgaagagggacaaaacgttgatctttacatccccaggaaatgttctgctaccaacagggtgatcacttcaaaggatcatgcttctgttcaacttaatgtaggccatttggatgataagggcttgtatattcctggcagtttcactacttttgctctctgcggtttcatccgtgctcagggcgatgctgacagcgcactggatcgcctctggcagaagaagaaagtcgaagcgagacaacagtagaaaaatagatttgctatttgagattatcttgtgatggaggatttatgataactatttcaatttcatctgagtttgacactgtttttcctctacatatgggatagcttttcatctttggatatttcacttgcctttcatggttttgagca

SEQ ID NO: 6453 - DNA, 456 bp, Artificial
  Synthetic
ttcacctcaggttgttaaagcttgatcggagtattcagaaacgctagccaagatgcagaatgaagagggacaaaacgttgatctttacatccccaggaaatgctctgctaccaacagggtgatcacttcaaaggatcatgcctctgttcaacttaatgttggccatttggatgataagggcttgtatatacctggcagtttcaccacttttgctctctgtggtttcatccgtgctcagggtgatgctgacagcgcactggatcgcctctggcaaaagaagaaagttgaagcgaggcaacagtagaaaaatagatttgcaatttgagattattttcttatgatggaggatttatgataactatttgaatttcatctgagtttgacactgttttccctgctacacatgggatagcttttcatctttggatatttcacttgccttatggttttgatccc

SEQ ID NO: 6454 - DNA, 742 bp, Artificial
  Synthetic
gcccacgcgtcgcccacgcgtccgcccacgcgtccgcccacgcgtccgcccacgcgtccgcccacgcgtccgaacttacaaagccaagaaaccattgaagcacataacaaacgcgggttcgaaaaccggcaacaagtggtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttt

SEQ ID NO: 6455 - DNA, 322 bp, Artificial
  Synthetic
cccccccccaccgtggtctccgtcactactggggtctccgtgtccgcggtcagcacaccaagactactggcaggaggggaaagactgtcggtgtctccaagaagagataaattccatgcccatcggctcagcaaattcattttgcttgtcttatgagcgtttcaatgatgtcagtcttgataggcagttttgttggatgatgcttttgtctaagaagatagatcgtgcgttgcaggaatctcaaaacttttatatattgtaacttggttgtttggtaccgcaaattctgaagcctaatttttttactggatgtgtttctggt

SEQ ID NO: 6456 - DNA, 573 bp, Artificial
  Synthetic
acgcgtcggtttgtaggcggctcggcggcgaagatgtctctggtgagcaatgaggagtttcagcacattcttcgtgtgctcaacaccaacgtggatgggcggcagaagatcatgtttgcgctcacctccatcaagggtatcggccgccgcttcgccaacattgtctgcaagaaggccgatgtggacatgaacaagagggctggtgagctgaccgctaccgagctcgagaacctgatgctgatcgttgccaacccgcggcagttcaagatccccgagtggttcctcaacaggaagaaggactacaaggacgggaggtactcccaggttgtggccaacgctctcgacatgaagctcagggacgacctggagaggctcaagaagatcagaaaccaccgtggtcttcgtcactactggggtctccgcgtccgcgggcagcacaccaagaccactggacgccgtggaagaactgtgggagtgtccaagaagcgatagatagccgcagcttttgtttggtctcttaatttccaatatgttttaagtgcaaattttaaaattcattaagaaaattaattt

SEQ ID NO: 6457 - DNA, 612 bp, Artificial
  Synthetic
gggagagggagagggagagggagagagagaagtcgaaaaccggctaatcttctcctctaatcatgtcgctgatcgccaacgaggatttccagcacattcttcgtgttctcaacacgaacgtagatgggaggcagaagatcatgttcgccctcacggcgatcaagggtatcggccgacgtttcgccaatctcgtctgcaagaaggcagacgtcgacgtcaacaaaagagctggagaactctctgctgcagagttggaaagccttatggtgattgttgcaaatcctagacagttcaagatccccgactggttcctgaacagaaagaaggactacaaagatggacgcttctctcaagttgtgtccaatgctttggatatgaagctcagggatgaccttgagaggctcaaaaagatcaggaatcaccgaggtcttcgccactactggggccttcgtgttcgagggcagcacacaaagaccactggccgccgaggaaggactgttggtgtctctaaaaagcgttaggggggtaattctagtttcttgttgtggctggcattttgaaatgtctcaattttatttagttttggagatgcggcatgtaacccatgtccag

SEQ ID NO: 6458 - DNA, 739 bp, Artificial
  Synthetic
  misc_feature (675)..(675): The residue at this position can be any nucleotide.
gttctttcttcttggagggtgtgtcgtagtttagctattggggaggggtagggataggatagaggcagaaagagaacaggaagaagaaagaagccggcgaagggtaagaaggggttttcctcagctctcaaccatgtctctgatcgccaatgaggatttccagcatatcctgcgtgtcctgaacacgaacgtggatgggcggcagaagatcatgttcgccctcacggccattaagggtatcgggcgtcgcttcgccaacctcgtttgcaagaaggccgacgtcgatgtcaacaagagagctggggagctttcggcggctgaacttgaaagcttgatggtgattgttgccaacccaaggcaattcaaaatccctgattggttcttgaatagaaagaaggactacaaagatggtcgtttctcccaagttgtatccaatgccttggacatgaagctcagggatgatctggagcggcttaagaagatcaggaaccaccgaggtcttcgtcactactggggccttcgtgtgagaggacagcacacaaagaccactggccgcagaggaaggacagttggtgtctccaagaagcgatagtcacctatattcttcttgctggcggattttttttatacatgttttgtcaatcttgatatcagaaatcgatgcagacggacagnccccccttctttgaccgtatcgcattggcaggatcctttagtttctaatgaacacaacggaagt

SEQ ID NO: 6459 - DNA, 644 bp, Artificial
  Synthetic
gaattcaagaaagagttccactcgagatcccttcagcaaaatgtctttggttgctaacgaagattttcaacacattcttcgtgtgttgaacactaacgttgatggaaagcaaaagattatgtttgctatgacctctatcaagggtattggtaggagattcgccaatattgtctgcaagaaagctgatgttgacatgaacaagagggctggtgaactatctgcagcggagttggagaatttgatgacaattgttgctaacccacgtcaattcaaaattccagactggtttttgaacagaaagaaggattacaaggatggaagatactcacaagttgtatcaaatgctcttgacatgaaactcagagatgatttggagcgtttgaagaagatcaggaaccatcgtggtttgaggcattactggggtctcagagtccgtggacagcacaccaagactactggtcgcagaggtaagactgttggtgtctccaagaagcgttgaagactggttgttattcttttgatcaaagaagttcttgtggtgaggagtttgtcattctgctttatagttggaacctagaaggacttaaattatgatactagtatagtttaggattttgaatatctcggaattttaatgtcctcca

SEQ ID NO: 6460 - DNA, 557 bp, Artificial
  Synthetic
gatctttctcggcatccaaaaatgtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcggccgcaattctcgagc

SEQ ID NO: 6461 - DNA, 259 bp, Artificial
  Synthetic
aaacctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagat

SEQ ID NO: 6462 - DNA, 572 bp, Artificial; identical to SEQ ID NO: 4366
  Synthetic

SEQ ID NO: 6463 - DNA, 582 bp, Artificial
  Synthetic
cccacgcgtccgcccacgcgtccgcccacgcgtccgttctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattggaaaaacatagccatctgtttgcgttg

SEQ ID NO: 6464 - DNA, 565 bp, Artificial
  Synthetic
acgggttgtacgccgagtagtagataacaatttctgtgtattggggatctaggcctatctgttttcttatacctatttttcttttcctcctccctggcttagtttttgcacctcgggatttgtatacatacacggccggatttaattctttccccaccaccaccaccacaacaacaacaacaacaaacatcgccgtcacaatgcgcttctccgcagctgctctcgtcgcggccctgcccgctctctctgccgcgcaagagaatcctctggaccaatacattgctcaggcccagcagatcttgggccaggtcagctcttacatcccgactcccaacaagtatgatgccgctgccgccgaagcgtccaagacgggccccatgaagctctccgtcttggcccagcacaactgggaggacactctctatgcgcctgtggccgccggcgcaaagacgcccgaggagtggtggatcttgatcactggtggaaacaagacgtgctttggccgatgtgaccggcttgaaagcgctttttacggtgctgctgcccagtttgcggagctcccaac

SEQ ID NO: 6465 - DNA, 522 bp, Artificial; identical to SEQ ID NO: 5123
  Synthetic

SEQ ID NO: 6466 - DNA, 859 bp, Artificial
  Synthetic
tctatcctttacagttcaaaatggccagttcaattcttcgagggagggcgctgggagccgtgcgccaggcccgttgcttcagctctactccaaggcaatatgccgctgatgtcaagagcgtcggtgttctcggcgccggccagatgggtctgggtatcgctcttgttgctgcgcaaaaggcgcaagttccggttactctcgtcgatgcttctgagcaggcattgagtaaaggcattgcttttgccgagaagctgctggccaaggacgtgtccaagtctagaattactcaggaacaggctgatcaagcccgctccctgctgaagactagtaccaagattgaggacttctcttctgtcgacttcattatcgaagctgtgcctgagatccctcagctcaagtttgacatcttcagcaagctggccaaggtagctcccgctcacgcaatcttggcgaccaatacctcttcaatctccatcacgcgcattgctgccgccactaccaacgatcctaatgacacctcggcttcatcgagagttgtttctactcacttcatgaacccggtccctgttcagaagggtgtagagatcattagcggcttgcaaaccagcaaggagacgcttgatacggcagttgagttctgcaagcggatgggcaaggtcacttccgtttcggctgactctcctggattcctcgccaatcgaattcttatgccttacatcaacgaagccatcatctgccttgagacggcagtgggcgacagagactcaatcgatgccattatgaagaacggaaccaatgtccccatgggtcctctgcagcttgcggacttcatcggccttgatacttgcttgtccatcat

SEQ ID NO: 6467 - DNA, 568 bp, Artificial
  Synthetic
gggttttttttcgggaagtttcagcattagcattacaccagtaaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcacagcgctgcgtcgatgatgaaaatggcctgatttcttgctcgcggagctatgccgggaccctgcaaccgcgaaatgggctgccaccggccacagagaaaa

SEQ ID NO: 6468 - DNA, 701 bp, Artificial; identical to SEQ ID NO: 4390
  Synthetic

SEQ ID NO: 6469 - DNA, 620 bp, Artificial; identical to SEQ ID NO: 4389
  Synthetic

SEQ ID NO: 6470 - DNA, 631 bp, Artificial; identical to SEQ ID NO: 4387
  Synthetic

SEQ ID NO: 6471 - DNA, 647 bp, Artificial
  Synthetic
tgatgtttaaatctactgtatttaccttcgcattaattaagcatggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaaggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactac

SEQ ID NO: 6472 - DNA, 624 bp, Artificial; identical to SEQ ID NO: 4373
  Synthetic

SEQ ID NO: 6473 - DNA, 695 bp, Artificial; identical to SEQ ID NO: 4380
  Synthetic

SEQ ID NO: 6474 - DNA, 784 bp, Artificial; identical to SEQ ID NO: 4376
  Synthetic

SEQ ID NO: 6475 - DNA, 611 bp, Artificial; identical to SEQ ID NO: 4377
  Synthetic

SEQ ID NO: 6476 - DNA, 681 bp, Artificial; identical to SEQ ID NO: 4391
  Synthetic

SEQ ID NO: 6477 - DNA, 274 bp, Artificial; identical to SEQ ID NO: 4978
  Synthetic

SEQ ID NO: 6478 - DNA, 705 bp, Artificial; identical to SEQ ID NO: 4397
  Synthetic

SEQ ID NO: 6479 - DNA, 530 bp, Artificial; identical to SEQ ID NO: 5132
  Synthetic

SEQ ID NO: 6480 - DNA, 653 bp, Artificial; identical to SEQ ID NO: 4445
  Synthetic

SEQ ID NO: 6481 - DNA, 598 bp, Artificial
  Synthetic
atcacaatgaactaccccgctgaacccgaattccaacaggcttacgacgagctctacaactccatccacgactcgactctgttcgacaagcaccccgagttcgagaaggtcatccctgtggtgtctgttcctgagcgaatcatccagttccgagttgtgtgggaggacgaccagggcaagctgcaggtcaaccgtggctaccgagtccagttcaactccgctctgggcccttacaagggaggtctccgattccacccttccgtcaacctgtccattctcaagttcctcggatacgagcagatcttcaagaacgccctgaccggcctcaacattggaggtggtaagggaggtgctgactttgaccccaagggcaagtccgacgccgagattcgacgattctgctacgccttcatgggcgagctccacagacacattggtgctgacactgatgtccctgccggtgatatcggtgttggtggtcgagaggtcggtttcctcttcggcgcctacaagaagtacaagaacacctgggagggtgttctgaccggtaagggtctgacctggggtggatctctgatccgacctgaggctaccggtt

SEQ ID NO: 6482 - DNA, 163 bp, Artificial
  Synthetic
agcacgaggagcttgacgccatctccgccaagttggctggcgacttccgcaccatatgagcctttcctagagggacttggacaagcacctgacgctgcgatcctacctcgagggctacactctcggagaactcgagaccaagatttggcagactctccgagcc

SEQ ID NO: 6483 - DNA, 629 bp, Artificial
  Synthetic
gctgcttcaactactctcgtcaagatggctgctgctcaggttactctctccgagcccaagaagctcgagggattctctctctactctcgtttcgccctcgctggtgccgtctgctgctccgtcacccacggtggtcttacccccgttgatgtcgttaagacccgtatccagctcgaccctgttacctacaaccgtggcctgatcggtggtttccgccaggtcatccagaatgagggtgctggcgctctcctgactggtgctggccctacctttgccggttacttcctgcagggtgccttcaagttcggtggttacgagttcttcaaggcccagttcatcaacggactcggccaggagactgcctccaacaaccgaactgccatctacctggcttcctctgccgccgccgagttcttcgccgacattgccctctgccctcttgaggccacccgtatccgtctcgtctccgagcccacctatgccaacggtctcgttggtggtttctccaagatgctcaagaacgagggtgtcggtgccttctacgccggtttcggacccatcctcttcaagcagatcccttacaccatggccaagttcgtcgtcttcgagaaggtttctgagggcatctt

SEQ ID NO: 6484 - DNA, 550 bp, Artificial
  Synthetic
acgatgaatacgcggcctgttcctgcaggatcgcatcgcggtcgcgagagagcagatcaacgaccagcagctgcagggggtctaacatcatggacatggctatctatctcctacacaacggatgcatccaagcacgaaatagatgggggaattagggggtacggaggcgggtgaaacaccagacgctcgtcagcgctcagcttcaacattcaagttctgtatcaaggttgtgaaacctcaaagctgcaccgtttcgttggtacagtgggccgagtttagagtgctagcccgaacagatttgaaacagccattaatggatctgtggaggcgcgcgtcaaaagcccacgatccgaatagaggcagagcggcagggcccgactcgacggaaacggccaagacatggccggctgagacaacgtctattgtattgctcgcctcgccagggaatgctctccatctggtcgacaatgcataatctccttctgtcttacacattaacggtcattgtaatgggcactttaatgaggacactttaacaaagtggctggcg

SEQ ID NO: 6485 - DNA, 217 bp, Artificial
  Synthetic
attccctagtaggtttggcgggtgagatacctgatacggcacgagcgtttgcagggcatccgattcgagcgaattgatggctttggtgcacaaaggaccgggaggttgcatttgggcattgatcttaggaggaatggagattgggagcagatggacgtcgattcgacctgtgacgtttggtgatgggtaaaaaataacagtattgcacatcacagag

SEQ ID NO: 6486 - DNA, 544 bp, Artificial
  Synthetic
gcagaggatctttggagcaaagagaaagaaaaaaagccaaccatcgcgacaacgcgcagcccgcctttcctccgacctctggcccttgtcaatctctcttcctcgttggaccctctttcgaagcgataaatcaacagctcgccaagatgattgacgatttgcccaacgatgccaagtccaaggaggtggtgagactctggcgcgcgtggaggactgttcacgagatggttgcggaccgagagtacgagctcgccgaagacgaagtcaccatctctctcgaccggttccgcgacgaatactggcatcccgacggcaccgtaaaccgcgccaaactccagttctccgcccgtcccagcgactccatgctccgcaaaaacacccctcccggcacagcctccaacccggaccccgtgcccgactgcgggcccatctgggtcgagttcctgacggacaagcagttcggcgtcggccagatccgccagtttgcaaagtacacaatctccaacaactacaagacgggcatcatggtcacccacgtgcccct

SEQ ID NO: 6487 - DNA, 451 bp, Artificial
  Synthetic
ggtctcgaagcgcagaacatcggaggagttggtagcagcagcttttccactttccaggacagtgtgtcctgggaaatagcgcataaacgccatgcgccaagcatgatgagtggtgaccagcgcccagaatcgcttcgacaccaacgccaccgaggagtggcagtcgggcggcagatgcgaaaagatgtgcgtcaggatctctggcagaacacttatcgagacggattccatccgagcggggttctgagcgctttataacctggaaaccaggcccttgcttcgcagcttgagtgttcaaagctttctcatactcggagattcgctgtccaggcacagaagggagatcgtcgaggcccttgtccaggctcaatcgtcgtagcttctcgtccagctggtcggcattgactccagcatcttcgcccgggaggggctgatgctgatgctggtccgg

SEQ ID NO: 6488 - DNA, 650 bp, Artificial
  Synthetic
actgcttcaagatgtccatgacaaccgaagactgtaccaaggtccggcccgggttcccgcggcgggtcccggagacgcccgagaaagtgtttgaacagtttcaaatgagagacaaggtcgtcattgttactggagcggcagatggtattggtcttgctgtgactgaggcgatggcagaggcgggcgcaaacgttgctctgtggtataactcgaatgatgcggccgttgagaaagcaaagacccttggcgagacttataagatcgcagctgccgcatatcaagtcgacatctctcaagctgagcaggtgagcagaaacattgctaaagtagtccaagactttggcaagattgatgtctttgttgcaaacgcgggtatggcaatctcgcggcccattctagagcagactctagacgagtaccgcaaacagatgtctgtaaatgtggacggcgtagtcttctgctccaagtacgccggcaaagtcttccaacgtcagggcttcggcaacttcatcatcacatccagcatgagcggccacattgtcaacgtgcccgtagaccaaccagtgtacaacgccaccaaggcctttgtcacgcactttggaaagtctctagctcgtgaatggcgcgagtttgccagagtcaacatcgtg

SEQ ID NO: 6489 - DNA, 472 bp, Artificial; identical to SEQ ID NO: 4577
  Synthetic

SEQ ID NO: 6490 - DNA, 300 bp, Artificial
  Synthetic
ggatacggtacggtgagccaaacggaaatgacggaggattatttcaggcaaggtggaggcggggaggaagatggataggaaaagtgtctcggagagagtgcggttttgagttaaacgttgtgtcacaatgtttctgaattgtgaggacggctgttttcggggctgaaaatgtcatgaagccggaacattatttcgtcacaagggagttgagtgttagttacgcaaggtggtattaattagcatcctgtgtttgttgttcatgtaatatctgttaatattacgctgttgctgccttctatt

SEQ ID NO: 6491 - DNA, 722 bp, Artificial
  Synthetic
gctcaattgaaccatccagacatcatgtttctgcagcgaggatcaagagtgctgagacggcaatggggggcttccaaggccatgggcaagatggccctgggaaacacagcgcctacagctccccggtggttctcggagtcgaggagattatatgccgtcaagccggtgttgctggctgacatcggcgaaggcattgtcgagtgtgaggttatccagtggttcgtcgagcccggcgcgcacgtcgaggaattctcccctctatgcgaggtccagagcgacaaggcgtctgtagaaatcacaagccgcttctccggcgtcgtcaagaagctttactacgagacgggcgagatggccaaggtgggcaagccgtttgtcgacattgacatccaaggcggggccgaagccgacgacgctggcgcgcccaaggcggccgaacccagcaaggacggagcctcatcttcaacaccagcacccgagccaaagccgcagcagactgaaaccagtgcgccggcacagggacagagcagccaagcccccaaggccaagggcaaggccgcggcactggcgacaccggcggtgcgacatctgtccaaggagctgaagattgatatcctcgacatcgacggcacgggcaaggatggcagggtcctgaaagaggacatttacaagtttgtgcagcagagggatgccagtgccagtgcatcggctgcttcacagtctgc

SEQ ID NO: 6492 - DNA, 692 bp, Artificial
  Synthetic
gagagaggaaggtcgaggatagaggaggagcaggagattggagattagggtagctgaggaagagccatagccatagccagagccatagccatagccatggaggtcgcggcagagagtgcagtggtggccccggcaacggccaagaccgtgaaggatgtggcttcccatgactttgttcgttcttacgctagtcacctcaaacgaaccggcaagattgaagttcctgcgtgggtggatcttgtcaagacctcaacagccaaggagcttgccccgtatgatccagactggtactacattagagcagcttctatggctcgcaagatttacctaagaggcggtgtcggtgtcggagctttcaagaaaatctatggaggatcgaagagaaatgggtcaagaccatcccacttttgcaagagcagtggatcaattgcccgagatgttcttaagcaactcgagaagattgacattgtggagaaggaccatagaggtggaaggcgtatcacctcgaatggacagcgtgatctagatcaggttgctggaactgtctcagtgaaagttgtttaatttaatatgcataattcaacttttcgtagtttaggatttttgtaggcatatagtttaatttaaacatagaccggattatagcatctttgcttagtggtttattgtgttgacttgagtgattagtactg

SEQ ID NO: 6493 - DNA, 443 bp, Artificial
  Synthetic
ggtgtttccgttagagacgttcccgctcagaagttcattgaggcttacgcttctttcctcaagcgacagggtaagcttgaggtccccggctacgttgagatcgtcaagacctctgccggcaacgagctccctccccaggatgctgagggatggttctacatgcgagctgcctccattgcccgacacatctacctgcgaaaggaggttggtgttggcaagctcaacaagctctacggtggtgctatcaaccgtggccagcgaccttctcaccacaaggacgcctccggctccgtcaaccgacgtgctctgcaggctcttgagaagcttggtgtccttgaggccggtctcaagggtggccgacgaatctccgagaacggacagcgagatcttgaccgaatcgccgcccagactctcgaggaggaggaggatgacgagtaaatttg

SEQ ID NO: 6494 - DNA, 729 bp, Artificial
  Synthetic
cccccacaaacccttgctgcaactcgtaggagagagacgcacgggcgccgcagtagcagcagagccaaaaaatggagccagcgagaaatgtgaaggatgtttcacctcacgcgttcgtgaaagcttacgccgctcacctcaagcgttccggcaagatggagcttcctgagtggactgacattgtcaagactggtaaactgaaagagcttgccccatacgaccctgattggtactacattagagctgcttccatggcaagaaagatatatctgagaggaggtcttggagttggtggattccgaagaatttatggtggtaaccagaggaatggaagccgcccacgtcatttctgtaagagcagtggttcagttgctcgcaacatccttcagcaattgcagaacatgaacatcattgactttgatcccaagggtggaaggagaatcacatccaacggccagagagatcttgaccaagttgctggaagaattgctgttgccatttaagagatgaaagcaagcgttattatgaatacatgagttgcttcaaacttataatttcagcttgcaccatatagatgtagggcgatgaatcaattttctgcatatttttgcctttttttcttttatcatgggattctttttgcatcagtatgctagttttgtcctttcagtactttaagatgttacttgggcctgccctctatttgagcataacattcttatttgcgtt

SEQ ID NO: 6495 - DNA, 732 bp, Artificial
  Synthetic
gagagaggaaggtcgaggatagaggaggagcaggagattggagattagggtagctgaggaagagccatagccatagccagagccatagccatagccatggaggtcgcggcagagagtgcagtggtggccccggcaacggctaagaccgtgaaggatgtggcttcccatgactttgttcgttcttacgctagtcacctcaaacgaaccggcaagattgaagttcctgcgtgggtggatcttgtcaagacctcaacagccaaggagcttgccccgtatgatccagactggtactacattagagcagcttctatggctcgcaagatttacctaagaggcggtgtcggtgtcggagctttcaagaaaatctatggaggatcgaagagaaatgggtcaagaccatcccacttttgcaagagcagtggatcaattgcccgagatgttcttaagcaactcgagaagattgacattgtggagaaggaccatagaggtggaaggcgtatcacctcgaatggacagcgtgatctagatcaggttgctggaactgtctcagtgaaagttgtttaatttaatatgcataattcaacttttcgtagtttaggatttttgtaggcatatagtttaatttaaacatagaccggattatagcatctttgcttagtggtttattgtgttgacttgagtgattagtactgaaattataaagagggagatggttaatgaccctaagactga

SEQ ID NO: 6496 - DNA, 689 bp, Artificial
  Synthetic
ggcggcggcggcggcaggatgggggattcgacggcgaggacggtgaaggacgtgaaccctcatgagttcgtcaaggcctactccgcccacctcaagcgctccggcaagatggagctccctgagtgggttgacatcgtgaagactgcgaggttcaaggagctccctccttatgatccggactggtactacacgagggctgcctcgattgcaaggaagatctacctgaggcagggtattggtgtaggtggcttccagaagatctatggtggccgccagaggaatggctcacgtcccccgcacttctgcaagagcagcggcgctatctcacgcaacatccttcagcagctgcagaagatgggcatcatcgatgtcgaccccaagggcggaagactcatcacctcccagggaaggcgtgatctggaccaagtggccggaagagttgatgttaccatcgcctgaacagatccatggatcttcaacccttactgcctctcatatgtttggtggttgagtcggctacagtttgtttgcagttttgaattagaacatgccctatctttggttgagtcggctacagtttgtttgcagttttgaattagaacatgccctatctttgctggctcagagaattggaagttggatgcatctaggtgtgatactgcagtatgtgttttgtcttttcctgaatg

SEQ ID NO: 6497 - DNA, 549 bp, Artificial
  Synthetic
  misc_feature (347)..(347): The residue at this position can be any nucleotide.
  misc_feature (450)..(450): The residue at this position can be any nucleotide.
gcaacacacacaatgtccttcaacttcaacgattctctcaacagtctgtccaccaccttctccccatgggccaagcgaacccagcgaatggtccaggagaagctcggcaacgtggaggacgtgaccgagctcccccaggagtacctggagctggaggctcgagttgacgctctcaagattgtccaccagaagctgctcgccgtcacctctaactacgaaaacgagggctacgactaccctcccaacctgcgggagtccctgtctgacctgtctaagaccatcaccgagaaggtgcagggtctgtcccaggtgtcttctgctgccgaggcccagtctgtgctcaccanccccggctccaagaaggaccccaagaccatgaaccatgctcttggccgagctgctcttggtggtgttgctgccctcaaggaggccggtgccgactctgacgancccctgtccgagtctctccagaagtacgccattgccgaggagaagattggtgagggccgactgtcccaggaatacctgatcgccaacaagttcaacgcc

SEQ ID NO: 6498 - DNA, 603 bp, Artificial
  Synthetic
ccccgggacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccacttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggaaaaaaaaaaa

SEQ ID NO: 6499 - DNA, 557 bp, Artificial
  Synthetic
cccacgcgtccgccccgagcagaagccgccggcgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgtcc

SEQ ID NO: 6500 - DNA, 657 bp, Artificial
  Synthetic
gttatgagatttggaaaaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgttttgccgtgtcattggtgttgcaagtaaggttctcgtttttgtgccaaaaaaaaaaaacaa

SEQ ID NO: 6501 - DNA, 476 bp, Artificial
  Synthetic
ggcgacgaagagagaggagagatccaagatggtggtcgccgggaagaagcagaagaagacccaggagagcatcaacaacaggttggcgctggtgatgaagagcggcaagttcactctgggctacaagacggtgctcaaatcgctgcggagtgggaaaggcaagctcgttctcatctccaacaattgcccgccgctccgcaagtcggagatcgagtactacgcgatgctctccaaaaccaacgtccaccattacagtggaaacaatgtggagcttggtaccgcttgcggcaagtactatcgggtctcttgccttaccatcacagatccaggcgattcggatatcatcaaatccatgtccgccgagtgaaaatccatccatcgatcagcgctcctctgttttgtttcgctgttcaacttcttgtaggcctcttactctagaaatatggaactttaatggaaaaacatttccttcatag

SEQ ID NO: 6502 - DNA, 620 bp, Artificial
  Synthetic
gctaatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacgtaagttttgcaatctcagacgccctggacaagtgaagacctggaaacgggtatatctacttgcgccattacacacttctcgcttctttcagaagctactcttgctacccgagaattgccaattcttgcggaattgcccagagaagaagtctttcagactttggagggttcacattggcttacattattcgtaaaacagattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggt

SEQ ID NO: 6503 - DNA, 683 bp, Artificial
  Synthetic
cgttatttattatgcatcttgactacccctcgaccacgcgtccgcccacgcgtccgcccacgcgtccgcgccgtcgacgcatttgcctcttcctataatttccgactacatatctccaggccagagccaaccatggttgctgcaaagaaaaccaagaagactcatgagagtattaataacaggctggctctggtaatgaagagcggcaaatacacattgggatacaagactgttctcaaaactcttagaaactccaaaggcaaactcgtcatcattgccaacaactgccctcctctcaggaagtctgagatagagtactatgctatgttggcaaagattggagtccaccactacaatggaaacaacgtagatttggggactgcatgtggtaagtatttcagagtctgttgcctcagcatcattgatccaggtgattctgatatcattaagagcatgcctggtgaccagtgagatagcagctgatgttagatcgctccaatgaacactgctcaatcatagtggaactttgccgtttttccttattgagacaaatatctagtttagatgagttttgctactttggtgatgttaaaaggaagttttgatggtatttggaatcttaatgacatcaattttttttcctggagttttgaatcttctaattgactgtcatttgttgctta

SEQ ID NO: 6504 - DNA, 680 bp, Artificial
  Synthetic
gccattacggccggggatataactaacattagaaacctcggccacttccctttccccgttgtttcagagtgtttttatcaacaaaaatggcgacaacagggaagaaaacgaagaagacccatgagagcatcaataacaggttagctctggtaatgaagagtggcaagtactctctcggttacaagaccgttctgaagaccctcaggagctctaaagggaagttgatattgatatctaacaactgcccaccattgagaaagtcagagattgagtactatgctatgcttgctaaagttggtgttcaccatttcaatggaaacaatgttgatcttggaacagcatgtgggaagtatttccgtgtttcatgcctcagcatcattgacccaggtgattcggacatcatcaagtctctacctggtgatcactaagagatattcaccagggttttgctaaaccattttagtgagttgagaaaatctgtactatctttttattcttgtatttcagagttataccaagattatagaggatgttggtattatctagttttgttggttttatcatttctccagaagttttgaggtcaggtacattatgattttattcacagatcaatttccctataccattttgcttttctaaatgagttcactagattttcttgttgttaaaggaaaaaa

SEQ ID NO: 6505 - DNA, 606 bp, Artificial
  Synthetic
attctcttggaggcaaaggagagagagagagagagagagagagaggttgcaggttccggtagcaaggaaggcgcaaccatggtggcagcaaagaagacgaaaaaggctcaagagagcatcaacaacaggttagccctggtcatgaagagtggcaaattcactcttggatacaagactgccttgaaatctctccgtggtggcaaagcaaaacttgtcatcatctcgaacaactgccccccactaaggaagtctgaaattgagtactacgctatgctctccaagacaggggtgcatcagtacagtggaaacaatgtggacttaggcacagcctgcgggaagtactatcgcgtcagctgtcttagtatcacagaccctggtgattctgacatcatcaggactgtggagtagggatgagagttcaaaccaagtttagtgtggaagtaggacgtcttttaattcctctgagcatgcaagggggccgagttttgcctcttcactggaatttattgattagcctgttaacctctgcttaaagagaacttggctattttgtagatggctaagtcttgattgatgatgaaatatggtcattgcgttttcttttcc

SEQ ID NO: 6506 - DNA, 587 bp, Artificial
  Synthetic
ggaaaaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgtttt

SEQ ID NO: 6507 - DNA, 648 bp, Artificial
  Synthetic
ccgacctcgcagtcgccaccccgagcagaagccgccgccgccgcccgaaaccctcgccgccgtcgcttctcctcggggcgcagccatggtggccgcaaagaagacgaataagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattaaaacgcttggctgtttgttcactgaacttcgcatcatta

SEQ ID NO: 6508 - DNA, 661 bp, Artificial
  Synthetic
cgaaccctcgcagccgcatcgcgccggcgcctcctcctccccctccccctccccctccggcgagagagcccgcgccgttgccgccgccgccgccgccgccatgtcgctgatcgcgggggaggatttccagcacatcctgcgtctgctgaacacgaacgtggatgggaagcagaagatcatgttcgcgctcacctccatcaagggtgtcggccgccgcttctccaacatcgcatgcaaaaaggccgacatcgacatgaacaagcgggctggtgaactcactcctgaggagcttgagcgcctcatgactgtggtggcaaaccctcgccagttcaaggtccctgactggtttctgaacaggaagaaggactacaaggatgggaggttctcccaggttgtttctaacgccctggacatgaagctcagggatgaccttgagaggctgaagaagatcaggaaccaccgtggtcttcgtcactactggggtctccgtgtccgtggtcagcacaccaagactactggcaggaggggaaagactgtcggtgtctccaagaagagataaattccatgcccatcagcacagcaaatgcgttttgcttatcttatgagcgtttcaatgatgtcagtcttgatagggcattttgttggatgatgcttttgtcta

SEQ ID NO: 6509 - DNA, 683 bp, Artificial
  Synthetic
gcaggagagagggagggagagggagagggagagggagagagagaagtcgaaaaccggctaatcttctcctctaatcatgtcgctgatcgccaacgaggatttccagcacattcttcgtgttctcaacacgaacgtagatgggaggcagaagatcatgttcgccctcacggcgatcaagggtatcggccgacgtttcgccaatctcgtctgcaagaaggcagacgtcgacgtcaacaaaagagctggagaactctctgctgcagagttggaaagccttatggtgattgttgcaaatcctagacagttcaagatccccgactggttcctgaacagaaagaaggactacaaagatggacgcttctctcaagttgtgtccaatgctttggatatgaagctcagggatgaccttgagaggctcaaaaagatcaggaatcaccgaggtcttcgccactactggggccttcgtgttcgagggcagcacacaaagaccactggccgccgaggaaggactgttggtgtctctaaaaagcgttaggggggtaattctagtttcttgttgtggctggcattttgaaatgtctcaattttatttagttttggagatgcggcatgtaacccatgtccagtagtatttagccacatggaaacaatccttttcatcattagaatgcgaacacaacgga

SEQ ID NO: 6510 - DNA, 531 bp, Artificial
  Synthetic
accggtcgacccataactacacgccaaaatgtccctcgtcgtcactgaacaaggcaacttccagcacattcttcgactcctcaacactaacgttgacggccgaatcaaggtcatgtacgccatgtgcaagatcaagggtgttggtcgacgatacgccaacctggtctgcaagaaggccgatgtcgatctctccaagcgagccggtgagctcaccgtcgaggagctcgagcgaatcgttactatcatccagaaccctggtcagtacaagattcccggctggttccttaacagacagcgagactttaccgacggtaaggactcccagctgctcgttaaccagcttgatgtcaagctgcgagacgatattgagcgactcaagaagatccgagcccaccgaggtctccgacactactggggctacaaggtccgaggtcagcacaccaagactaccactcgaaagggtaagatcatggctcaccgaggttaaaacgtgcatgtacatgtaaaattattaaaatgctattgaggacc

SEQ ID NO: 6511 - DNA, 630 bp, Artificial
  Synthetic
gccattacggccggggagggttttggtagttctgcatctcttcaggagtgaacgaaacagccgcaccgcggagcagaattcgaaactgtagcaatgtcgctggttgcaaatgaagaatttcagcacatacttcgtgtgcaaaacacgaatgttgatgggaaacagaagataatgttcgcaatgacatctatcaaaggtatcggccgtcgtttcgctaacattgcctgtaagaaagccgatatcgatatgagcaagagggcgggtgagctttctgctgctgaactcgatagcttgatggtggttgtggcaaatcctcgccaattcaaaatccccgactggtttttgaataggcaaaaggattacaaggatggtaagttttcgcaagttacatctaatgctctggacatgaagcttagggatgatctggaacgcctaaagaagatcaggaatcatcgtggtttgcgtcattactggggtcttcgagtccgtggtcagcacacaaagaccactggtcgtcgggggaagactgttggtgtctccaagaagcgataatctcctttcccctgagccagttttgcatggttatgctattttgtttttatatgcagcaacaaagtttgaatggagtta

SEQ ID NO: 6512 - DNA, 747 bp, Artificial
  Synthetic
ctcacatctcttgaatacagaagaagccgccgccgcacagagcaagatttgaaacctagcaatgtcgctcgttgcaaatgaagaatttcagcacattcttcgtgtgcaaaacaccaacgtcgatgggaagcaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatgggaagttttcacaagttacctctaatgctcttgacatgaagcttagggatgatctcgagcgcctgaagaagatcaggaatcatcgtggtttacgtcactactggggtctccgagtgcgtggtcagcacacaaagaccacagggcgcagggggaagactgttggtgtctccaaaaagagataaatcatctacttgttcagtttgttatgtgctttctctttatgtgctccgggcgatacatgtttaagatattttaggggattttgtgttggtatgcttaaattttcctttccgttggtggattacagtataatttttttccatagtgacaaggatttctctgctttatgatctaggttttgcaagatgatcttgaattaaattgaatgagtatttccttaaatatactc

SEQ ID NO: 6513 - DNA, 774 bp, Artificial
  Synthetic
gcatctctttcaaactaaagcagccgcagccgcagccgcactgtgccgaaagcagtgaaaccctaaccatgtcgctggttgcaaacgaagagtttcagcacattcttcgtgtgcaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgatagcttgatggtggttgtggctaatcctcgccaattcaaaatcccagattggtttttgaacaggcagaaggattacaaggatggcaagttttctcaagttacatctaatgcacttgatatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaatcatttacttgccagttcctttatgttttatgcttctctttggtatgtggagtccgaacacccgcaggaagtttattaggtattttgtaatgtttgcactggaattttctagtcttgccatttggagggttatagttcctataaatcctctggcggcattgcaagcatttgtttattgtgggatcaaagttttgccggttttacgcttgaattattacattgattgagtactttttattgagatgc

SEQ ID NO: 6514 - DNA, 447 bp, Artificial
  Synthetic
cccacgcgtccgcttttgtgttcttcactctccagcgatcgtttattgcttgaagacggcttcttcttctcacaaatctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagatcccagactggttcttgaacaggcagaaggattacaaagatggcaagtattctcaagttgtctccaatgctcttgacatgaagctgagagatgatcttgaacgtctcaagaagatc

SEQ ID NO: 6515 - DNA, 349 bp, Artificial
  Synthetic
aaacccgaaaacctcaaaccatggccgagggactcgtattgaagggcattatgcgcgcccacaccgacattgtcacggccatcgctacgccgatcgacaattccgacatcatcgtcacagcgtcgcgtgacaaatccatcatcctctggaaactcacaaaggacgataagtcttacggtgttgctcagcgtaggctcacaggtcactctcacttcgtggaagatgttgttctctcatcggacggtcagtttgcactctccggaagctgggacggtgagctccgtctctgggatcttgccacgggagaaacaactcgtcgattcgttggtcatacgaaagatgtgctctc

SEQ ID NO: 6516 - DNA, 415 bp, Artificial
  Synthetic
cccacgcgtccggaaggtgatggtcacaaggaatgggttagttgtgttaggtttagtcctaatactcttgtaccaactattgtatctgcttcttgggataaaactgtgaaagtttggaatctccagaactgtaagctgaggaactctcttgttggtcactctggttacctcaacactgttgctgtctcgcctgatggttcgctatgcgccagtggtgggaaagatggtgttatcttgttgtgggatttggctgaaggaaagaagctttactcgcttgaggcgggttcgattattcactcgctttgcttcagtcctaacagatactggttgtgtgctgctactgagaatagcattaggatttgggatcttgagagcaagtctgttgttgaggacttgaaggttgatctcaagtctg

SEQ ID NO: 6517 - DNA, 615 bp, Artificial
  Synthetic
gctcaggcagaggcgtgcttaagaagagagagagagagagagagacagagagagagagaggagagagagagagagaagctgcaatggccgagaccttagtcctgcgtgggaccatgaaggggcacactgactgggtcacgtcgatcagtacgcccatcgacaactccgacatgatcatctcgtcatcccgcgacaagtcgctcctcgtttggtccctcacccgcgaggagggcacctttggtgtccccaagcgccgcctcaccggccatgcccacttcgtccaggacgtcgtcctctcctccgacggccagttcgcgctctcggggtcgtgggactccaccctccgcctctgggacctcaacactggtgccaccacccgacgctttgtcagccacaccaaggacgttctctctgtcgccttctccgctgacaaccgacagatcgtctccgcctcgcgtgaccgcaccatcaagctctggaatacccttggcgagtgcaagtacaccatccaggaccaggatgcgcacaccgggtgggtgtcgtgcgtgcggttctctcctgtgacagcgaacccaactgtcgtttctggatcgtgggatcggactgtcaaggtct

SEQ ID NO: 6518 - DNA, 712 bp, Artificial
  Synthetic
gacggagaagaagggtctaagaccttgaatcagagcagctatggcggagactctagtcctccgcggcaccatgaagggccacacggattgggtcacctccatcagcacccccatcgacaactccgacatgatcatctcctcgtcccgcgataagtcgctcatggtctggaatctcacccgtgaggaaggcgtctacggtgtccccaagcggcgcttgactggccatgcccacttcgtccaggatgtggtcctatcgtccgacgggcagttcgccctctccggttcgtgggactcgactctccgcctctgggacctggctaccggcgccaccacccgccgctttgtcagccataccaaagacgtgctctccgtcgctttctctgccgacaatcgtcaaatcgtctccgcctcccgtgaccgcaccatcaagctctggaacacccttggtgagtgcaagtacaccatccaggaccaggacgcgcacaacggatgggtctcgtgcgtccggttctcccccgccaccgccaaccccaccgtcgtctcgggatcgtgggaccggaccgtcaaagtgtggaacctcaccaactgcaagctcaggaccacgctctccggccactcgggctatgtcaacactgtcactgtgtcccccgatggctcactctgcgccagcggtggcaaggatggcgtcaccatgctctgggaccttgctgaa

SEQ ID NO: 6519 - DNA, 1206 bp, Artificial
  Synthetic
ctcgaccacgcgtcgtatcgtttacactatcctcttcttctccgccttcacagcgaaaccgagagcagccactctcccattacctgcccgataaaatggcacaagaatcactagtcctccgcggaacaatgaaagcccacaccgattgggttacagccatcgccaccccaattgacaactccgacatgatcgttacttcctccagggacaagtccctaatcgtctggtctctaacaaaggacggcccacaatacggtgtcccccgccgccgtctcactgggcacggccacttcgtccaagatgtcgtcctttcctccgacggcatgtttgctctctctggttcctgggacggtgagcttcgtctttgggatcttcaagctgggaccaccgctcgccgtttcgtcggtcacactaaggatgttctgtgcgttgcattctccgtcgacaaccgtcagatcgtttccgcttcccgtgacaaatccatcaagctctggaacactctcggtgaatgcaaatataccattcaggatggtgactcacattctgattgggtttcatgtgttcgtttcagcccgaatacacttcagcccactatcgtttctggatcctgggaccgtactgtgaaaatctggaacctgactaactgtaagctgaggtccactctggctggacacgccggctacgtgaacaccgtggcagtctctcctgatggttcattgtgtgctagtggaggcaaagatggtacaattttgctttgggatttggctgaggggaagaagctctactcgcttgatgctggctctatcattcacgcgctctgctttagtcctaacaggtattggctgtgcgcagctactgaaactagcattaagatttgggatttggagagcaagagcattgtggtggatcttaaagttgatctcaagcaagagagtgagatggctactgaaggaactattggctctgcctgcaaaaacaagatcatgtactgcacctgtttgagctggagtgctgatggaagcacgcttttcagtggatatacagatggtttgattagggtttggggtattgggcgttattaggagttggccatagtcatttaaagacatttagatttctcttgaaatgtttgaagaatgatatctggattctctctgtttctcatggttttgagagttttgttgttccaattttgggatgttattt

SEQ ID NO: 6520 - DNA, 288 bp, Artificial
  Synthetic
cccacgcgtccgcgaaaaccctagtttcagaggcatctccagacaccgaaaatggcggaaggactcgttttgaagggcaccatgcgtgcacacactgacatggtgacggcaatcgccaccccaatcgataacgcagacatcatcgtctcagcttcccgcgacaaatccatcattttgtggaaactcaccaaggacgacaaagcctacggtgtagctcagaggcgtctcactggtcactctcacttcgttgaggatgttgttctctcctccgatggacaattcgcgctt

SEQ ID NO: 6521 - DNA, 630 bp, Artificial
  Synthetic
gggcggacgcgtgggaccaccaccacctgtttgacgaaatgtcggaatcgctagtactccgcggcacaatgagggcccacactgactgggtcacagccatcgccaccccagttgacaactccgatatgatcgtcacatcctcacgtgacaaatccatcatcgtttggtcactcacgaaagacggcccacaatacggcgtcccccgccgccgcctcacaggccatggacacttcgttcaagatgtcgtcctttcatccgacggcatgttcgctctttccggatcttgggacggtgagctccgtttatgggatcttcaagctggaacaaccgcccgtcgtttcgtcggacacactaaggatgttttgtccgtagcattttctgctgataaccgtcagatcgtgtcagcatcccgtgataagagcatcaggctttggaacactttgggtgagtgtaagtacattattcaggacggagagtcgcattctgattgggtctcatgtgttcgtttcagcccaaataatcttcagccaactatcgtatccgggtcgtgggacaggactgtaaaaatatggaaccttaccaactgtaagctccgtgctacgcttgctggacacactgggtatgtgaata

SEQ ID NO: 6522 - DNA, 364 bp, Artificial
  Synthetic
gcataatacaacatgagccacaacgttcttcttgttctccgaggaacccttgagggccacaacggctgggttacctccctcgctacttcttccaacaaccccgacattctgctgtccggatcccgagacaagtccctgattgtctggtctctgacccgagacgacaccaactacggtgttccccgaaagtctcttaagggccactcccacattgtccaggactgtgccatctctcatgacggtgcttacgccatctccggctcttgggataacactctccgagtctgggacctgaagaccggtgtctccaatgaccgatctgtcgggcacacctggtgacgttcttcccgtctctttctctccc

SEQ ID NO: 6523 - DNA, 661 bp, Artificial
  Synthetic
gtcttcaccagctaaaactctctttcctcacccatctcttcaatcctttgcgcagaggcgaggctgtacacaatggctgaacaactgatcctcaaaggtaccctcgagggccacaatggctgggttaccagcttggccacctcaatggagaaccccaacatgctcctgtctggtagccgagacaagaccctgatcatctggaacctcacacgcgacgagactcaatacggataccccaagcgatccctccacggccactcccacattgtgtcggactgtgtcatctcctctgacggtgcctacgccctctctgcctcttgggacaagaccctccgtctgtgggagctcgccactggcaccaccacccgaagattcgtcggccacaccaacgatgttctctccgtctccttctccgccgacaaccgacagattgtctccggctctcgtgaccgcaccatcaagctgtggaacaccctcggtgactgcaagtacaccatcaccgacaagggccacactgagtgggtttcctgcgtccgattcagccccaacccccagaaccctgtgattgtttccagcggttgggacaagttggtcaaggtttgggagctgcccagctgcaagctgcagaccgaccacatcggccacaccggctacatcaaca

SEQ ID NO: 6524 - DNA, 97 bp, Artificial; identical to SEQ ID NO: 4414
  Synthetic

SEQ ID NO: 6525 - DNA, 82 bp, Artificial; identical to SEQ ID NO: 4417
  Synthetic

SEQ ID NO: 6526 - DNA, 605 bp, Artificial
  Synthetic
aaagagagcgttttttttttacttgactttgggtttggatgctggaatagaaagacgatacacaagacaaggaatcagacaggacttgcacaagacatagatcacaagaaacgcgacctcacctcatcctcgacgatgcctttcaacacagagctcacccgccgcctgggcattcgcgtccccgtcatccagggcggcctcatgcacgtcggcaccgcagacctcgcgtccgcagtctccaacggcggcggcctgggcatcatcaccgccctcatctcccccacgcccgaagccctgcgcgccgagatccagcgctgccgcaccctcaccgacaagccctttggcgtcaacctgaccctcctcccgtccctcctcccgcccgactacccggcctacgcccaggccatcatcgacgagggcgtcaagattgtcgagacggccggaaactcgcccggcccggtgattcgccagctcaaggccgcgggcatcacggtgctgcacaagtgtacgacgattcgtcatgcccagagcgcgatcaagttgggcgtcgactttttgagcattgatgggtttgagtgcgccggacatgttggcgagagcgacat

SEQ ID NO: 6527 - DNA, 579 bp, Artificial
  Synthetic
ggacaagctcaacgccatgattgccggcaccgagctcgaaacccacgacgtcaagaccatcctcctcatgacggcccgcgaacccagccaagcccccatcttcaaccacgcctccatggcgcacaacaaccacttcttcttccagggcatcgccccccaaggcacccccatgcccgacgagctgcgccgcgagctcgaggcctccttctcctccatcgagtccctccgcctcgagttcatcgtcaccgcctccgccatgttcggccccggattcgtctggctcgtcaaggccggcccgggagactaccgcctgctgcccacctacctcgccggctcgccttacccgggcgctcactggcgcatgcagtccaccgacatgaacaccgttggcaatgatggctctgcgcgctcgtatcttaggaaccagagcctcggcgctaggaggagggtcggcgacttgcctccgggaggtattgagttggagccgctgctgtgtcttaatacttgggagcacgcttggttgctggactggggtatgggcgtggatggaaagggcgggaaggctgcctatgttgatgc

SEQ ID NO: 6528 - DNA, 640 bp, Artificial
  Synthetic
ccccccccggggtcctcgtctcctcgcgccgccgccgccgccgcggacgccgccatgtcgaagcgagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaagataatgctggggtgattgtgaatcccaagggtgagatgaaaggttctgctatcactggacccatcgggaaggagtgtgctgacctttggcctaggatagctagtgcagcaaatgctattgtctgagcttgtttgaatgaattgtaagacagctatatgacctcaggatcgtctgcaaatggtttactaggacaactgtggaactttgtgatgctatcgtttgtttgcccgttgcagttttgtagtgaacagaagttgccatccatatgatattttatttgccatctaa

SEQ ID NO: 6529 - DNA, 617 bp, Artificial
  Synthetic
cccacgcgtccgcaaacatcagaagccctagagcttgagccgtcgaaaatgtcgaagcgaggacgtggaggaacgtctggtaacaaattcaggatgtcacttggtctgcccgttgcagccacagtgaactgtgcagacaacactggtgctaagaacctttacatcatctctgttaaaggaatcaaaggtcgtctcaatcggttaccttctgcttgtgttggtgacatggttatggccactgtcaagaaaggtaaaccagacctcaggaaaaaggttcttcctgctgtgattgttaggcaacgtaagccatggcgccgaaaggacggtgttttcatgtactttgaagataatgctggagtgattgtgaaccctaagggagaaatgaaaggttctgcaattactggacctattgggaaagagtgtgcggatctctggccaaggattgctagtgctgctaacgccattgtctgaagatcatttatcacttttgctggttatgtatctgtcttcaacgaaacgcgaaatagttggtgttttgagtgttttaagtagagacgacaatcttttgtgagcttcagacatatttccagtttctaagagattttgcttagattaaa

SEQ ID NO: 6530 - DNA, 466 bp, Artificial
  Synthetic
ccccggccgccgccgccgccgcttgtcaccccttccgtttccaagatgtcgaagcgagggcgtggaggtagtgctggtaacaagttccggatgtcactgggtctgccagtggcagccactgtgaactgtgctgacaacactggagcaaagaacctttacatcatttctgtgaagggaatcaagggacgccttaacaggcttccttctgcttgtgttggggacatggttatggctactgtgaaaaaagggaagcctgacctgaggaagaaggtcatgccagctgtcatcgtgaggcagcgcaagccgtggcgccgaaaggatggtgtctacatgtactttgaagacaatgctggagtcattgtgaaccccaagggagagatgaaaggttctgccatcactggacctatcggaaaggagtgcgctgatctctggcccaggattgcaagtgcagcaaatgcgatcgtct

SEQ ID NO: 6531 - DNA, 650 bp, Artificial
  Synthetic
agagagggagcagcagagcaagaccgtcaacaatgtcgaagagaggtcgcggaggttccgcggggaacaaattcaggatgtcactaggtttgccggtggcagctaccattaactgcgccgataacactggtgcaaagaacctttacatcatttcggtgaaaggtatcaaaggaaggcttaacaggttgccatcagcttgtgtgggtgacatggtcatggccacagtgaagaagggtaagcctgatctcaggaaaaaggttatgccagctgtcgttgttcgtcagcgcaagccgtggcgccgaaaggacggtgtcttcatgtacttcgaagataatgctggtgtaattgtgaatcccaaaggcgaaatgaaaggatctgcaattacagggccaatcgggaaagagtgtgctgatctgtggcctaggattgcaagtgctgctaatgctatcgtataggagagcctttgaatagtttgagattctcgttttgatggttgatttaagtttttggatatcagatagctgtcttattaagagttacagagtattagttttgctagctgtaagaattttgcatcaagaatacagaactagtatctgtttctactgtttgttatttactttttcaggtgaatgctttgaccaaaaaaa

SEQ ID NO: 6532 - DNA, 679 bp, Artificial
  Synthetic
cccccccccgcttctcactggctagagggagagtgaagagcaacgccgtccaacaatgtcgaagcgaggacgtggaggttccgctgggaacaagttcaggatgtcgttgggtttaccggtggcggcaactattaactgtgccgataacactggtgcaaagaacctttacatcatttcggtgaagggtatcaagggaaggcttaataggttgccttcagcttgtgttggtgacatggttatggccactgtgaagaagggtaagcctgatctcaggaagaaggttatgcctgctgtcgttgttcgtcagcgcaagccgtggcgccgaaaggatggtgttttcatgtactttgaagataatgctggcgtaattgtgaatcccaagggtgaaatgaagggatctgccattactggtcccattgggaaagagtgtgctgatctttggccaaggattgcaagtgctgccaatgctatcgtttagtttgagaattgtgttttccaatagtttatttgagtttttgaatatcagggagttcttttcttggtaagaattagtgcaactggctatgagaattttgctgcactccaaatgtttttgtctatgtaggacattactgtttccttttcttgttgatgtgtttgttacgagtaaaagaaaatatgttgaactaatttattctct

SEQ ID NO: 6533 - DNA, 704 bp, Artificial
  Synthetic
ggaaagaaaagcttgacgacggagctatggcgaagcctgtggggggaggagcgaagaaggcgagggcatcccggaatagggaggtggtgcggggagtcgggcggtgtagccggtcccagatgtaccacaagaggggcttgtgggccatcaaggccaagaacggtgggtccctccctgcccatggtaagacccaggtcgcccctcaagcccccttagccaaggcccccaagttctaccctgccgacgatgtcagaaaacccctctgcaataagcgcattgctaagcctactaagctcagatccagcattacacccggaactgttctaattctccttgctggacatttcaagggaaagagagttgtcttcctgaagcaacttgagtctggattgcttcttgtcactggccctttcaagattaatggggttcctattaggcgtgtgaatcaggcatatgtgattgcaacctcgactaagctcgacacaagttccgtcgacaccagcaagttcaccgatgcatatttcaagagggaggttgagaaaaagaagaagggcgaggctgagttctttgaggctgagaaggagaagaagaccctccctcctgcaaggaaggaggatcagaaagagctcgacgctaagctggttccagtcatagagaagattccagacatgaaggcatatttgatggctagattcagtctcaaa

SEQ ID NO: 6534 - DNA, 630 bp, Artificial
  Synthetic
ggcaggaagaaggaaggaggagagagagagagagagagagagggagagggagagggagagatggcaaagcctgagggaggagcgaaggggccaagggcatcccggaacaagtcactggttcgaggcgtggggcaatgcagcaggtcgcagatgtaccacaagaggggtctatgggcgataaaggcgaagaacgggggctgtctaccggtcctcaccaagcccaaagcgatggacacctcggactccaaggccgccgccaaaacccccaaattctaccccgccgacgacgtgcccaaacccctggttaacaagcgtataatcaagcccaccaaactcagagctagcattacccctggaactgtgttgatcctccttgctggacactttaagggaaagcgagttgtattcttgaagcagcttgagtctggactacttcttgtgacaggtccgttcaagattaacggtgtccccctcaggcgtgtgaatcaagcatatgtgattgcaacctccacaaagcttgatatcagctgcgtcaatgctagcaagatcactgatgcgtacttcaagagagaggtagagaagaagaagaagggcgaagcagagttcttcgaggctgagaaggagaagaag

SEQ ID NO: 6535 - DNA, 880 bp, Artificial
  Synthetic
cccccccccccgaaaccttcactgctccatatatggatgcacattactaggtttagggttttattgaatcagcattctgcaaaagcaaaggagaacttctactttcagcaatggcggcaaagaagagtccccgtaatccagagctgattcgtggagtcggaaaactttcccgttccaagatgtatcacaaaaagggtctttgggcaatcaagaagaaaaacggcggctctttccccgtccacaaaaaagccgccgccgtcgcaccaccggccgtcaaaccacccaaaatttaccctgccgatgacgtggcaaaaccccttgtcaacaaacacaaaccaaaacccacgaaacttagagcaagtattacacctggtactgttttaattatccttgcgggtaagtttaagggtaagagagttgtgtttttgaaacagcttaaatctgggcttttacttgttagtggaccatttaagcttaatggtgttcctttgaggcgcgtgaatcaagcttatgttattggtacttcaactaaagtggatatttctggtgtgagtgttgagaagtttgacgataagtattttgcaaagcaagctgagaagaaacagaagaagggtgagggagagttctttgaagacaagaaagaggagaagaagaatgtgcttccacaggaaaagaaggatgaccagaaagctgtggatgaagcattgatcaaagccgttgaatgtgttcctgaattgaaggcttatttgtcagctaggttctccctcaagtcgggcatgaaaccccatgagcttgtcttttaggctgtgagatgtttaaaatactctttatgaaattgattttgttagatttattttgggttatgttctgttttggacct

SEQ ID NO: 6536 - DNA, 765 bp, Artificial
  Synthetic
ccggctctcgccctctccgcaccagctccccgccgagagcgccgcgagctgatccaatggcgccgacgtcgaagctgtcgcagggcatcaagaaggcgtcgcggtcgcacacgtaccaccgccgcgggctgtgggccatcaaggccaagcacggcggcgccttccccaaggccgagaagcccgccgccgcagccgccgccgccgcgcccaagttctaccccgccgacgacgtcaagccccgccagcccagcacccgcaagcccaaccctaccaagctcaggtcgtccatcacgcctgggacagtgctgatcctgctcgccgggaggtacatggggaagcgcgtcgtgttcctcaagcagctcaagtccggcctgctcctcatcaccggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggcaaccaagaatctgcccgacttcaagaaggatgaccagaaggctgtggatgctgagttgatcaaggctatcgaggttgtcccagacctgaaatcctatcttggtgcccggttctctctcaggtacggcgacaagccccatgagatgacattctaagttagtcggtacaagtttcaagttctgaggaagtcttttt

SEQ ID NO: 6537 - DNA, 291 bp, Artificial
  Synthetic
atatcagacacccgagagagtcaatatgtcggccaagcccacgaccaagcagttcgggaagtcgacccgggaggttcccgcctccgcggaccaggcgaagaagtggtaccctgccgacgacgagagcgccccgaagaaggttcgcaagtccgcccgatacgtcatcgccacctcctacaaggtcgacatctccggccttgacgccgccaagattgacggagatctctcagcccaagtacttcaccgccgagaaggccaaggagaaggcttccgctgaggctttcttcaagc

SEQ ID NO: 6538 - DNA, 702 bp, Artificial
  Synthetic
agcgtcgcaaatcaaagatgcctcctaaggataagaaagccgcttccaccggtgctaagaccgaagccgcaggtactaaaaaggctggttccgtcagaatctccaagtggtacccagctgatgatgtcagacgtatccgcaaaaaccctgctaaagctcccaagcctgtcgccctcagaaagaacattgctccaggacaggttttgatccttcttgtaggcaggtttaagggaaagagagttgtcttcttgagacaactcaagtctggtctactcttggtcactggtccttataagattaatggtgttcctcttagaagagttaatcaaagcactgtcatccacacctctactagagttgaccttggtcaagctaaattcgataagattgatgatgattacttcaagagaataaaggccaagagaaccaagaagactgaagaagctttcttctctgctggtacccaagaaaaaccccaagaagagaaagacaagcttaatgagaagaaaaagactcaggtcgaagtagatactcctattctagccgctgttaagaagaccgaactcttaagacaatatctcagaacaagattcaccctctctaaatacactaagcctcatgaattggtcttctaagggttcagagacctgctccaaaaacatgtggatatgcttgtatgaaatagcgaagtatctatcctcg

SEQ ID NO: 6539 - DNA, 670 bp, Artificial
  Synthetic
acaacaccctaaacatcaaaaatgtccaagcagatcggaggagccaagaacggcggtagccgaaccgtccccactgagaaggcccccaagtggtacgtcgctgagcccactcacgtcaagatccccaccgtccagaacaagtccaagctgcgaccttctcttgttcccggtgccgtactcattctccttgccggccgattccgaggcaagcgagttgttctcctcaagtctcttgaggatggcactctccttgtgaccggtcccttcaaggtcaacggtgtccctctccgacgagtcaacgcccgatacgtcattgccacctccactaaggtcgatgtctccggtgtcaaggctgacaagttcacccctgcctacttcgctcgatcttccgccgacaagaaggccgagaagcagttcttcgccgagggcaagcagaaggagctcaaggccgagcgagtcgccgaccagaaggacgtcgatgctgctctcattgccgagatcaagaagactcctcttctcaagcagtacctggcttcccagttctctctcaagtctggtgacaagccccacctgctcaagttttaaattataaaaacacaaaatggaacatgggggtggaaaatggtggacggtggtgaagccgtcgtctgtcaaaagctgtatagcaatg

SEQ ID NO: 6540 - DNA, 650 bp, Artificial
  Synthetic
acatatcagacacccgagagagtcaatatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagctacctcgccagcaccttcagcctgcggaagggtgacaagcctcacgagatggcgtggtaaatttgattcaaacacaaaatctctctggcaggtccaaagcacggggtggagtttactggggtgttggtcaagatgcgggttgtaaaacggaaagg

SEQ ID NO: 6541 - DNA, 430 bp, Artificial
  Synthetic
gcgccgacccgagctgtggccggtgtggcaagcggcctgtcccggctggtgcctcgttctcgtccacggctgccaattgcctctgtttctattacagcaaagacgacggcatcatcgcgatggcactcgggcttctcgtcggtcaaccccaacgaggtctcacacttcaatgccctcgccgctgagtaggtgggagccgcacggatcgtcgcgcctactacacctcatgaacccgctgcgccacgacttcatccgctcctgtcgcgagtcctccgacgacctcaattccatcacatacctcgacattggctgcggcggcggcatcttcgctgagagcgccgcccgcctagccaccaccaagcacgtcaccgccatcgatcccacaccgtccgtcctcaacgtcgcaaaagcacatgcccgcaaagaccct

SEQ ID NO: 6542 - DNA, 132 bp, Artificial
  Synthetic
gattgattgctcaaacatcacaacatcagtcaatctctccaaatggctcggtcagccgccacaacggccaccaaagaggccaagcctcaggctactgctgctgctgctgctcctccagctccagctccaacc

SEQ ID NO: 6543 - DNA, 625 bp, Artificial
  Synthetic
aagaagggggtggcgaaacctcaccctccatcctccatcctctcctttcttccttcgaggaggaggagctatatatagacggggatggttcatctagcctcctcaccggttttgatttgatctgtgtgatttgagtgagtgagtgagattctttggaggagggattttggtttggtttggtttggtggtttgtgcgggattttgtggggaggagagtaatggcgaccgcagggaaggtgatcaagtgcaaagcggcggtggcatgggaggccgcgaagccgctggtgatcgaggaggtggaggtggcgccgccgcaggccatggaggtgcgcgtcaagatcctcttcacctcgctctgccacaccgacgtctacttctgggaggccaagggacagactcccgtgttccctcggatcttcggccatgaagctggaggtattgtggagagtgttggagagggtgtgactgatcttgcccctggtgaccatgttctccctgtgttcactggggagtgcaaggagtgtgcccactgcaagtcagcagagagcaacatgtgtgatctgctcaggatcaacactgacaggggtgtgatgattggtgatggcaaatcacgcttttccatcaa

SEQ ID NO: 6544 - DNA, 823 bp, Artificial
  Synthetic
aagggaagaagaaagtggggaaagaaaataataatttaagtgggctgggctttgacatggaaaagaacggcttagtaataattgaagttagaatcgcatctatttgaagtgccactcatccctcagaaaaacactgttagtattttcactcacaaattcattctgtggtccgaattggagttcatagatcatggctacacaaggtcaagtcatcacctgcaaagctgcggtggcctgggaacccaacaaacctctggtgatcgaggatgtacaggtagctccaccgcaggccggtgaagtccgtgttaaagttctctatactgctctctgccacactgatgcttatacctggagtggcaaggatcctgaaggtctcttcccatgtgtgcttggtcatgaggctgcagggattgtggaaagtgtcggtgaaggagtgactgaggttcagccaggagaccatgttataccttgttaccaggctgaatgcagagaatgcaagttctgcaaatcaggaaagaccaacctttgtggtaaagtaagggcggctactggggtaggagttatgatgaatgaccgccagagtagattttctatcaatggaaagccaatctatcatttcatgggaacttcaaccttcagtcagtacactgttgtccatgatgttagtgttgcaaagattgacccagtagctcctctggagaaagtctgccttcttggatgtggtgttccaaccggccttggagctgtttggaacactgcaaaagttgaaccaggttccattgttgctgtctttggcctgggcacagttggtcttgctgtggcg

SEQ ID NO: 6545 - DNA, 760 bp, Artificial
  Synthetic
cccacgcgtccgaacagaggagaaatatggaaacacaaggcaaagtaatcacttgcaaagctgctgtggcatggggagctggagagcctctagtaatggaagatgtaaaagtggatcctcctcaaagattggaagtgagaattcgaatcctcttcacttccatctgtcacactgatctcagcgcatggaaaggcgagaacgaggctcagcgagcataccctcgaatccttggccatgaggcagcagggatagtggagagcgtaggggaaggtgtggaagagatgatggcaggagatcatgtgctccctattttcacaggagagtgtggagactgcagagtgtgcaagcgagacggagccaatctgtgcgagagattccgagtggatccgatgaagaaggtgatggtaaccgatggaaagaccagattcttcaccagcaaagacaacaaaccaatctaccattttctcaacatatccaccttctccgagtacacggtcatagactcggcctgcgtgctcaaggtggaccctctgtttcctctggagaagataagcctcctcagctgcggtgtctccactggagtcggtgcggcgtggaatgtggctgatattcaacctgcctccaccgtcgctatttttggacttggcgctgttggacttgccgtggctgaaggtgcaagagccagaggagcctctaaaatcattgggatcgacatcaaccctgacaagttccaactaggcagagaagcagggattagtga

SEQ ID NO: 6546 - DNA, 643 bp, Artificial
  Synthetic
atttattgaagaaggtaatcagttttcatttctctccttgctcctgaactactccagctatggcttccactcagggccaagtcatcacttgtaaagcggcggtcgcatgggaggcgaagaaacctctcgtggtagaggaggttcaggtggcccctcctgcccaaggagaagtcaggatcaagattttgtacactgcattatgccataccgatgcctatacgctcgacggactggatcccgaaggccttttcccctgcattctcggccatgaggccgcagggattgttgagagcgtgggggagggagtgacagaactgcaaccaggtgatcacgtgatcccttgctatcaagcagagtgtagggagtgcaagttttgcttgtcggggaagacaaacctttgcggcaaggtgagggttgcaacaggggttggggtcatgctgagcgaccgccagagccggttctcttgcaaggggaagcccttatatcacttcatggggacgtcgacttttagccaatacacagtagtccacgatgtcagtgtcgccaagatcaagcccgaagctcccctagagaaggtttgcctcctcggatgcggcattcccacaggtttgggggcagtttggaatactgcaaaggttgaacc

SEQ ID NO: 6547 - DNA, 99 bp, Artificial
  Synthetic
gctttgcgaatcgagatgttccgggcagctggagcgatcgcgacgcgcgccaggtccggcgccgcggcagccgctagcactgtaagtatcagggcaagc

SEQ ID NO: 6548 - DNA, 418 bp, Artificial
  Synthetic
aactaacccacccatcacacaatgttcgcgctccgagcctcaagaaacgttctgaagagccgacccgtgttcgctcgaggcctggcctccaccgccgaggcccctaaggtgcctgccccccgaatcaagaagtttggcatctaccgatggaacccagacacccccgaaaagaagcccgagctcaaggagtacgaggtcgacctgtcacagtgtggccccatggtgctggacgcgctcatcaagatcaagaacgagcaggaccccaccctgacgttccgacggtcgtgccgagagggcatctgtggctcctgtgccatgaacattgagggccgaaacaccctcgcatgcttgtgccgaatcaatcccgacatcgccaaggaggagaagatctaccctctgcctcacatgtttgtcgtcc

SEQ ID NO: 6549 - DNA, 401 bp, Artificial
  Synthetic
aatctatccaatctccgcgtctttggtttcccaaggtttgtcatcaatggcgaccggtttaatccgacgagcgatttctagggtccactcatcgccggtggcgaagctagttgtcgcccgagcacacgcatcggaggcccaagcccatcaatcagaatccaagcaacagccaaacatcaagtcatttcaaatttaccgttggagtccagacaatccaggtaaacccgagctcaaggaatacaaaatcgatctgaaagaatgtggcccaatggtcttagatgctttaataaaaatcaaaaacgaaatcgacccatcacttacgtttcgtagatcctgtagagaagggatctgtgggtcctgtgctatgaatattgatggttgcaatggacttgcttgtttga

SEQ ID NO: 6550 - DNA, 579 bp, Artificial
  Synthetic
ccgccgccgccctcctctccgggaagaagagaccagagcgagcgcgcgcgccgccggagcaaacccctcctcctacccttcagccatggtgctctccaacgacatcgacctgctgaacccgcccgcggagctggagaagctcaagcacaagaagaagcgcctcgtccagtcccccaactccttcttcatggatgtcaagtgccagggctgcttcagcatcactactgtgttcagccactcccagacagtggtggtctgcccgggctgccaaaccgtgctttgccagcctacaggtggaaaggccaggctaacggaggggtgttccttccgccgcaagaatgattaagatctaaatatctgaaagcaaaaaaaaagaaaaggcttgaacgagcttagtttctccaggatgtagtctgaaaattttgcaatgcctgtcaagtgaaccccatgtttggtaatttaatctctgggattatgtcatgactctggtactttgttggttggtctggagagtaagatgagatgtagggctacgtgaacaaccgtatgcttggcatgaatgaattgatattcctgggt

SEQ ID NO: 6551 - DNA, 637 bp, Artificial
  Synthetic
catctcagtcggtctgtcattattatcgacccacgcgtccgcgcaggttcgaacatccaaccttccacggacctgccgccatggtgctctctaatgatattgatcttctacaccctccagctgagctggaaaagaaaaagcataagctaaaacgtctcgtgcagtccccaaactcatttttcatggatgtgaaatgtcaggggtgctttaacataacgactgtatttagccactcacagacagtggtggtttgtggtaactgctctactgttttatgtcaacctactggtggtaaggctcgcctgacagaaggatgctctttcaggagaaagagcgagtagactgggcattgcttgcctcctaccattgcaagatttaattgcacgggtatttaatgtcttcgttgaggagcatagaggataacgaagtatgttgagtcggtcatttcgagtgttgtttcctgtcatcattactagacactgttgaatcatcggcatagaatcttggcactatgattttggaaaaatgcatagaattttagaaacatgatattggagacatttgattgttagcacttttgaagaatattaaatcatatgatagacattttattgttagcactaaaaaccaaaacaca

SEQ ID NO: 6552 - DNA, 709 bp, Artificial
  Synthetic
cccgaaaaaccctccggctcattcttgcccacgccgcgccgcctcctcctcctcctcctcctcctcctagggcttcttcttcttcccctcctccgagcgccgccgccgccgccgccgccgacgagatggtgctatccaacgacatcgacctcctcaaccctcccgcggagctcgagaagcacaagcacaagaagaagcgcctcgtgcagtcccccaactcattcttcatggatgtcaagtgccagggatgcttcaacataacaaccgtgttcagccactcccagactgttgttgtgtgcccaggctgccaaacggtgctctgccagcccacaggagggaaggccaggctcaccgagggctgctccttccgccggaagggcgactagagtgagtcgttcattcagaagacgatgtttttgtgccaagcaagtgttccacctccaaggatgtagtcttcgagttttgctctagttagcacagaaatatctattttgcaagtgttatgttatgtatcccgagctacttctgaacattgtcatcttggaggtctaattagttgggtttatttgagattgttcgatgaactaaattggtggttgatagtctcaggggcaaactgtttgaattataagctggtgtggaagatatttattgacatctcgttttgtgtttgacagtagaaagctttacccattcgtcggtttttact

SEQ ID NO: 6553 - DNA, 361 bp, Artificial
  Synthetic
ttgccgttgcttgctatctttcgccgtcgtctctttagcttcttgcgaagatggttcttcaaaacgatatcgatctgcttaacccacctgctgagcttgagaagaggaagcacaagctcaagcgtcttgtccagtctcccaattccttcttcatggatgtgaagtgccaaggctgcttcaacatcactactgttttcagtcactcgcagactgttgtggtgtgcggaaactgccagacaattctgtgccagcctacaggaggaaaggcaaagctcaccgaaggatgctctttcaggagaaagggtgattgattgaagcaatcatcaaaataatgaaggctgttttctttttcttttttttt

SEQ ID NO: 6554 - DNA, 592 bp, Artificial
  Synthetic
gcggtctcttcctgctgaagctaccgccggcctccagccatggtgctctcaaatgacattgaccttctgcaccctccagccgagctggagaaaaagaagcacaagctaaaacgtcttgtgcagtctccaaactcttacttcatggatgtgaaatgccagggatgcttcaacataacgactgtgtttagccactcacagactgtggtggtctgtgggagctgctcctctgtcttgtgtcagcctaccggcggaaaggctcgcctgatggaaggatgctctttccgaagaaagggtgattaatttgatagaccatctttacccctcacccccgtaagcatattgctagagattggtggtggtattacatctgctgattgttcccgaggtttgtgggtctgttgcggtaggattaggtagatgaattagcatggaatcctgacaaacagttttggcaacattcaaattaattgaaaaacattacttcatattatgcattgcttaatgcaagtgatagcatttaattttgatttttggcaacattcaaattgactgaaaaacattactccatattatgcattgtttaatgcaaaaa

SEQ ID NO: 6555 - DNA, 568 bp, Artificial
  Synthetic
  misc_feature (551)..(551): The residue at this position can be any nucleotide.
cccacgcgtccgcatcttcgctgcttgtggcgcaacacacagcctcccctcactctcatttcaattcatcttgcgaaaatggttctttcaaatgattacgatatgttgaacccgccagcagatgttgaaaagaggaagcataagctcaaacgtcttgttcagtctcctaactctttcttcatggatgttaagtgccaaggctgctttaacataacaactgtgttcagccattctcagacggtggttgtttgcggaaactgccaaacagttttgtgccaacctactggtggtcgtgctagacttaccgagggatgttctttcaggagaaagggagattagagagatagcattcaatttacattgaaatgaatcttcatatgggaattttgatgcagtactctattttaattttcactatctagtcttaattaagaacaagtgtttttgagtctactatgacttgattatgttatggttctaatttgagttatcccttttgaaattggattgttactacaatgttatctctgtggaggttccctgaaagtagntttctattctttttatt

SEQ ID NO: 6556 - DNA, 507 bp, Artificial
  Synthetic
  misc_feature (493)..(493): The residue at this position can be any nucleotide.
ttcatctcaacagactcggaggctaaataagctttactgcttggccaggcttctcttttaatctcgcgaaaatgactctcccaaatgatgtcgacttgttgaaccctcctgccgagctggagaagaggaaacacaaactcaagcgtcttgatgttaagtgccagggttgctttaacataacaactgtgttcagtcactcgcaaactgtcgtggtgtgcgggaactgccagacggtgttgtgccagccgactggtgggcgtgctagactcaccgagggttgttctttcaggagaaagggagactaaagatgagagaaagactacttgctttgcttttagagtggaagtgaaaagattttatatgggaaacaaaaagtcagttttgatgcaatcctgtttgtttaatggtcctttttgttttatctgtagtcttgagtaagaaagaacaagggttttgaatctgtttttttttttttaaattggattttgactangaaaaacaataaag

SEQ ID NO: 6557 - DNA, 591 bp, Artificial
  Synthetic
tctcatcgatctcatctcactgcgcctgcaaccatggcttgttgtaggctgaatttggagatgcatggaattcgagagtgaaatgatgattgtggctgaaatagttgaaagttggaaccccaatttcttggaaggttctatcaaatgacattgatctactgcaccccccagcttctctggagaaaaagaagcataaattgaaacgtctggtgcaatctccgaattcattcttcatggatgtcaaatgccagggctgcttcaacattaccactgtgttcagtcattcacaaactgtggttgtatgtggaaattgttcgactgtcctatgccaacctacaggaggaaaagctagactaactgaaggctcttctttcagaagaaagggcgattaagctaaatttccaacggttcatatgatctctcttttagctctgctcgaaaagaaacattgatatgttttcaatttcaaggcttttgtgatttcggtaaaatttgtcaatcagttttgggtatatgtatgaggcagcttaatgaaaatgcttaattagtgttcaagggtatattatgttagcccaaatgggctgagtattg

SEQ ID NO: 6558 - DNA, 596 bp, Artificial
  Synthetic
ggctgcccatggtcaattagcatactgcatgactcactgggagtttatcaagacggtgcctgtttttatgcaaacatgagtgggatcaagccaatgcacattctcaagttttcgaaaatttcaggactctcaaatgatattgaccttctccaccctccagtagagttggaaatgaagaagcataagctaaaacgccttgtgcagtttccggactcatatttcatggatgttaaatgccaaggatgcttcagcatgaccactgtgttcagccactcacagacagtagtggtatgtggaaactgctcttctgtcttatgccaaccaaccggggggaaggctcacttgacagaaggatctgctttcagaagaaagagcgaatagacacacctaactgcaaattattgttactgattaggcagtaagcattttgttacttagatttgcattcctgttttaagcactccactgacatttgtttcccagtatgagttgcttcgtttcatttgaaaggattggcgagatgaattagcataagcctcttgagaataatacaattttgggaatatttgagattttgaagagttaattctagtatg

SEQ ID NO: 6559 - DNA, 615 bp, Artificial
  Synthetic
gtgctgatttgccgccatggtgctctcgaacgacattgatcttctgcacccgccagcagagctggaaaagaagaagcacaagttaaaacgtcttgtgcagtccccaaactctttcttcatggatgtgaaatgtcaggggtgctttaacataacaactgtgtttagtcactctcagacagtggtggtttgtgggaactgctcaactgttctatgccaaccgaccggtggtaaagctcgtttgacagagggatgctctttcagaagaaagagtgaatgagaaaggtgctgctattaaactggtttgatcagtccccaatcagcctgattttgtagcagaccctgttgtaccgagttgatgtgaaaccaatggttgtgttttaaagtggccttattaccctgtaattagcttgattttgtactaagtgttcttattgagtccaaacaagaccaagggtcatgttctatttgtccgaattagcttgaagctgtacaagtcttattgtcttaagttcttatgattaatcactgcatgattaattttagagtatgttgtgatgaaggtaaaattatcacgactttggtagcaacgacacctaaataaatatattttttcac

SEQ ID NO: 6560 - DNA, 590 bp, Artificial
  Synthetic
agtggagtgtgcgtcgcaggttcgaacatccaaccttccacggacctgccgccatggtgctctctaatgatattgatcttctacaccctccagctgagctggaaaagaaaaagcataagctaaaacgtctcgtgcagtccccaaactcatttttcatggatgtgaaatgtcaggggtgctttaacataacgactgtatttagccactcacagacagtggtggtttgtggtaactgctctactgttttatgtcaacctactggtggtaaggctcgcctgacagaaggatgctctttcaggagaaagagcgagtagactgggcattgcttgcctcctaccattgcaagatttaattgcacgggtatttaatgtttttgttgaggagcatagaggataacgaagtatgttgagtcggtcattttgagtgttgtttcctgtcatcattactagacactgttgaatcatcggcatagaatcttggcactatgattttggaaaaatgcatagaattttagaaacatgatattggagacatttgattgttagcacttttgaagaatattaaatcatatgatagacattttattgtca

SEQ ID NO: 6561 - DNA, 1073 bp, Artificial
  Synthetic
agccttccgcttttcgcattggatacctattaaaagtctccgtttccccccatcaattgagagcctctctcttcatctcgccaaaacgatatttattccgccgtctgcgtattcttgcccgcatctctcacaacaccggcgtatcctgtcgtgtcgtgtaccaccgggctgtattttatcgtattgccttcatactacttacttaattcccgccaactttcatcgttcgccatgccgattcgaaatccgtttactcgccgccccggcactctcatcacagtcgaggacaatgtctacaccgaccaagagcgcatttctcccggctttgagcgagtcgacactgttggatccaaggcgtcgtcggctctcagcatccgcagcgccagaagtcaggataccggcgagtataagatgagtgtcgtcaatgatagcggcgtatatctccctccctcaccgtcggaggagaagggccactggccgcgcagatacctttcgtcgcgagaatcgtcagacagctctggcgagattgagcaattttctatttctcgagagtcgtttgactcgtaccgacgctcatttgatatctcggcacgatcccccatttctgcgtacgacgttcccgctcgcatgagtctcgactcagctcgattcgctcgaatgcctaggtcggcaatcaaccgtaacatagagcaactgcccaccgctgaggagaactttgaggacgtcggactcgaggaccagaagcagccgccccgcaaacgaggtttcttttccaaactgacagagacccaagagaaggactccactgctcagacaggagtctcgagattcctcatgcccggtcggaagagggctcaaagcggccaaggggccgagttagcggcaatggaccagccgacggtgacttcatcaaactgagaaatgcctgccacgggaagcaacgacgacaacgactctgcaacttgaaataatttatcgtacataccttttcaaaagtgtatcaggcgcccatgtttttttttctggactatggatatgttttatttctgcaacgacggcgtttgggacggcgt

SEQ ID NO: 6562 - DNA, 928 bp, Artificial
  Synthetic
gaatgacaacataggtggtacacaaacacatataagagggtgtgaagagccagtctctagcgtaaacatcacttctcttcatttctctcatctgcatcccaagaaaatatttcatcgtctgtatcacaccatgaatcccgatcctacctttcagggcagccagctcaggccaggaaccgcagcctatgatcaggcaaacgatatatacgccacgtcgacctatggaaaagagcgtaacatgaaccccggagagattctacaacctacatgtgtagaagacatccaaggtgttgttagatatgccaacaaagttggtaagccaattgccattaggactggtggtcatcagtacagcggtgcttcttcaactggacccaatggcattcaattggacttggaactcacgtttcgagacccgaagagggaccttgtcttgatccgcgataccgaaaacgacaaggtctatatcaaagcaagcgtcagctgggctctggctgaggtttatgacttccttcttgcaaatggcgtctttatgccgacaggccaatgcgccacggttcatctcggtggacatgtccagacaggtggttacggtatgctagctagatcctttgggcttcttggagattacatccgtgagctccaaatcgtggatcacaatggcgaagtggtcacagtgaccaaagagacgcaacccgacttgttctttggtcttctcggcggcagccccggcaacatcggagtcttgacgcatttcaaagtcgaagtccaagatgacaaaaagtaccaaggctccaagggactctggatggcgttccactaccgccaagacacgttgaaggagctcctcgacctcttggtggagaaagcagaagacccaaacttcccgcgcagctacgacttcaccgtcaatgtcgtcagtagggaa

SEQ ID NO: 6563 - DNA, 599 bp, Artificial
  Synthetic
aaagccccaaaatctcggcagtgaaaaaccaaaaaaatggatagcagccaagcagcagtgtcattcctcacgaacgttgcacgcgccgccttcggtctaggcatcagcgccacggttctcaactcctccctatacaccgtcgacggtggacaacgcgccgtcctcttcgatagattccgtggagtcatcgacgatactgtcggcgaaggaactcatttcctcgtcccatggcttcaaaagcctttcatcttcgacatccgtacgaggccccacacattttcctccgtttcaggcacaaaggatctccagatggtccacctcacactccggggcctctcacgccccgaagtttcgcgccttcccgccattttcaaaaccctaggtctagaatacgacgagaaagttctcccttcgatcggcaacgaggttttgaaagccgtcgtagctcaattcaacgcggatcagttactcacggagcgtccacaagtatcagctttagttcgcgagagcttgatccgacgtgctaaggatttcaacatcgtgctcgatgacgtggcaattacacacttgtcatacggtgcggagttctctaaagctgt

SEQ ID NO: 6564 - DNA, 587 bp, Artificial
  Synthetic
aagatgaatctcaacaatgttaaggttcctaagatgccaggtggtggtgcatcttctgctttgatcaaattgggagttgttgctggtcttggtgtatatggagttgccaacagtctttacaatgttgagggcgggcatcgtgccattgttttcaaccgtattcttggtgttaaagataaggtttatccagaagggacacacttcatgattccttggtttgaaaggccagtcatttatgatgttcgtgcacgaccccaccttgtggaaagcacttcaggaagtcgtgaccttcagatggtgaaaattgggctcagagttctcactcgtccagttccagacgaactacccactgtttaccgaactcttggtgaaaactacaatgaaagggtcctgccttcaattattcatgaaacgttgaaagctgtggttgcccagtacaatgctagtcagctcatcacccagagagagaacgttagcagagaaatacggaagatcttgacagagagggcagccaacttcaacattgctctagatgatgtgtccataacaagcctgacttttggaaaggaatttacagctgcaattga

SEQ ID NO: 6565 - DNA, 578 bp, Artificial
  Synthetic
aacaatgttaaggttcctaagatgcccggcggtggtgcagcttccgctttgatcaagttgggagtggtggctggtcttggtgtttatggagttgctaacagtctctacaatgttgatggtggacatcgtgcaattgtgttcaaccgtattattggtgttaaagataaggtttatccagaagggacacatttcatgatcccttggtttgaaaggccggtcatttatgatgttcgtgcacgccctcatctagtggagagcacttcaggaagtcgtgaccttcagatggtcaaaattggtcttcgagttctcactcgtcctgttccggaccaactacccactgtttaccgaacacttggtgagaactataatgaaagggtcctcccttccattattcacgagactttgaaagctgtggttgctcagtacaacgcaagccagctcatcacccagagagagaatgttagtagagaaatacgcaagattttgacagagagagcagctaacttcaacattgcgctagatgatgtgtccattaccagtctaacttttggaaaggaatttaccgctgcaattgaagc

SEQ ID NO: 6566 - DNA, 332 bp, Artificial
  Synthetic
cggacgcgtgggtcgacccacgcgtccgttcctggagctcctgctctctctgcccttcttaaggtcagcgttattggtgggctcggtgtctatgcccttactaatagtctctacaatgtcgatggaggacaccgtgctgtcatgttcaaccgattaactggtatcaaggaaaaggtgtacccagaaggcacacattttatggtgccatggtttgaaaggccaatcatctatgacgttcgtgcacgaccttaccttgtagagagcaccactggtagtcatgatcttcagatggtgaaaattggattaagggttctcacacgtcccatgggtga

SEQ ID NO: 6567 - DNA, 611 bp, Artificial
  Synthetic
ggcagcttctctcacaatcaccactctcttacacatacatctatcaactccttgttgtaaaaccaccaccacattcaaaatgaagttcttcgccgtcgccgctctcttcgtcgccagcgccatggccggcccaatgggcagcgaaggatgcccaggtggtcttactggcaccgttccgctctgctgtgccaccaacgtcctcggcctcgcgaccctcgattgcagcacccccactgttcctgtacccaatgtcggcatcttccaggcccactgtgcttccaagggcaaacagcctgtctgctgcactgttcccgttgccggccagggccttctttgcaacaagcccactggagctcagtagagtgcctgttgtacttggatggtgaaccccgtccacggcatcacggggttcacaacaccgacatcgaggggctcgcaaataggaggagttgaatggcaatggatgggtatggatgaaaatggatggacataggtggaactggatggatacagttgggcaatggatcatggtggaggacttaatggtatatttgcgagcgggataagggttgtatgtagagtcactcattaaatcacagctatcactgaaa

SEQ ID NO: 6568 - DNA, 795 bp, Artificial
  Synthetic
gacgtcatttggcttgtgatgacagaattgttttccgacataatgagctagcggactgaattgagacattcgagtttcactgctggtaccaggaaatcagcttcatcatcgacatcatttgacttgacgacatcttcacaatggccaaggatcatctacgccggcttctttccaacgcctcggaggagtcagatgaggaaggcagcttacctcgacacgtgaacaaagaagaaccaaggaagaaataccttgtttcgaaattatttctcaagtcctgctgctggtttttactattcttaatagcctgtattctgtctttctgggctgggacacgtgtggttcatgaggaatcaaatgcggatggattatgcgcaaaacacacgactcagtggtctcctctcattagagatgtaccagttcattacagcttcaaagagttcagcggctcttttatgaacgaagacgtttatcgaaaagttggatcaccagaggttgataaagcctgggaggatctcgggtctgactaccgagctggcattatttcatacaaagatggtctggctagtgggttggatccatcgtttgttcaacgaaacgaaaaatacggcggaggcttcatagttaacgtcgaaggaatgcaccatttgcattgtttgaatctagtgcgcaaagcactctacttcaactacgagcgatataaaaagctaggggagcatgcgtttgtaaacgatgactttatactacgcctacatattacgcactgcctagacactgttcgtcaggtcttaatgtgca

SEQ ID NO: 6569 - DNA, 676 bp, Artificial; identical to SEQ ID NO: 481
  Synthetic

SEQ ID NO: 6570 - DNA, 700 bp, Artificial
  Synthetic
gtccggccgctttcttctccttttcttccttttttatttccttgtacgccacagaaaacctataagctttctccttcttcttgctttccactttcagaaaaatcagaaaaagccccaaattcaaacccaaattcaaaaaatggcatctttcgcagaggcaccaccggggaacgaagcaacaggggcaaagatcttcaagaccaagtgtgctcaatgccatactgttgaacaaggtgctggtcataaacaaggacctaatttgaatggactttttggaaggcagtctggaaccactgctggttactcctactctgctgccaataagaatatggctgtgatgtgggaagaaaagactttgtatgattatttgctcaaccccaagaagtacatacctggaacaaagatggttttccctggtttgaagaagccacaggagcgtgcagacctcattgcctacctgaaatctgctactgcgtaaggaattaccgacagatattttctattttgtagtctgataggcatgttttgctgtgcgcaggaagataaaccattgatttttttaaagtaataagttgacctcttttggtcttgactcatttgtttccagagcactggtatacgaaattttttgttaccttctgaagaagaggtgaaaaacacttggcaaacaatgccaattttaacatctctcttatgattt

SEQ ID NO: 6571 - DNA, 536 bp, Artificial
  Synthetic
gagtggtcgtgagctttgcggcgtcgatctgcgatttccagggtaaagtggaatggcgacttttggcgatgccccggctgggaacgtgaagagcggcgagaaaatcttcaagacgaagtgcgcgcagtgccatgtcgtggaggcaggagctgggcacaggcaaggccccaatctccatggtttgcttggaagggtgtctggaacctgcgaggggtatagctactcgactgcgaacaagaacaaggctgttcattggagcgaggagacgctctacgagtacctcctgaatcccaagaagtacatccctggaaccaagatggtcttccccggcctgaagaagccgcaggaccgagcggatctcatcgccttcctgaagcagaactcttgacacgcgaaacgtttctactgcggcgcggggattcatgggggagggaataaagaggatttcccagagcgttttttcgagatccttggacttttttgttataagaaacatttgattcatttgattcattcccattccatttccgtggcag

SEQ ID NO: 6572 - DNA, 672 bp, Artificial
  Synthetic
gaattcacaaaccctagaaaagttgagaaggttgttccttcttattcttcctctcaaaatctctataagttttctgtaaaaagaagtttgaaatggcaactttcgaagaagctccacctggtgatgctaaggctggggaaaagatcttcaagactaagtgcgctcagtgccatactgttgagaaaggatctggtcacaaacaagggcctaacctgaatggtctgttcggaaggcagtctggaacaactgctggttactcttactcagctgctaacaagaacaaggctgtgaactgggaagagaatacactttacgattacttgcttaaccccaaaaagtacattcctggaacaaagatggttttcccagggctgaagaagcctaaggagcgagccgacctcattgcttacctgaaggaatcaactgcctaatccttttactgccccttggaattcattttggagacgcttttgaggtgtgacatgatcggatagcaacaaattttttcttaaataaacccttattttaggtttttattgctgtttcttttcaatcagaatagggagtagggatattgctctcttttgaaaagcaaaaacaccattttggggaacagaaattgtgacaaatttttatggaggcatatttcatcaacattcgatgggatcaaaa

SEQ ID NO: 6573 - DNA, 507 bp, Artificial
  Synthetic
ccccccgatcagtcattccaaggtcaacccaaaccctacctggtccgcgagtgcggtggcgatggcgacattctccgatgcgccgcccggggacgcggcggccggcgagaagatcttcaggaccaagtgcgcgtactgccatgccgtcgacaaggccgccggccacaagcatgggccaaacttgaacggtttgttggggaggcaatctggtacagctcctggtttctcttacccatctggcgacaagatagtgcctgtgatttgggaagagaacactttgtatgactacctgcttactcctaagaagtacactcctgccaagatggggttcaatggactgaagcagccacaggaccgtgctgatctcatcgcatacctgaagaacgtttgtaacttgtaaggtgaactttgcaacaaaactgtgttgtaaatttgtaataataagcagtggcctcgtggaagagacgatgtgcagctcatccacttgagcaggtgggagctattctt

SEQ ID NO: 6574 - DNA, 709 bp, Artificial
  Synthetic
ccccggcccacgagccagaaaaaaaaggaaaaagagagagtcgtagttcgcctcttcttcctcctctcgttctcgcggcggcggcggagatggcgtcgttctcggaggctcccccgggcaaccccaaggccggcgagaagatcttcaagaccaagtgcgcccagtgccacaccgtcgacaagggcgccggccacaagcaaggtccaaacttgaatggtctgtttggaaggcagtcaggtaccacccctggttattcctactctacggccaacaagaacatggctgtgatctgggaggagaacacactttatgactacctgcttaatcctaagaagtacatccctggaaccaagatggtcttccctgggttgaagaagccacaggagcgtgctgatcttatttcctacctgaaggaagcaacctcttaaaaggagtggagctgtcgtaacatgagacaatcggacaattcattctacagttaaataaaaatatttagacatctgggtcgctctggttttacagagtgcaatccacgagacaattatcttgttatattttgttcttatggtttatgggttccatatcttaggtttagcaggaaaagtctttcacagcttttgctttaactgctggaaaacaccagtattttgatcaccagtcggtgagactggattgcatcccttttggaaaaatactgagatccttaaat

SEQ ID NO: 6575 - DNA, 542 bp, Artificial
  Synthetic
agcagaatctatttaggatacttccgtccaacccagaatccaaaccctaaccctagttttgaggctcagtgcacatcggctatggcgacctttgcggaggctccggcgggcaaccccaagtccggcgagaaggtcttcaagacgaagtgcgcccagtgccacgctgtcgagaaatccgctggtcataagcaaggtcccaatttgaatgggctgtttggtaggcagtcggggactacagctgggtactcctactctgcatcaaacaaaaacaaagctgttgtgtggggagaggatacactctatgagtaccttctcaatccaaagaagtatattcctggcacaaagatggttttcccaggcttgaagaaacctcaagagcgcacggatctcattgcatacttgaaagaatctacgagttaatgaggcaattttcgattgcctttagaataattaattaattgagcttaatttagggttaggcaatctgcatttttggacccaataaataatttgcttaatcgggtatttttcctcgattccta

SEQ ID NO: 6576 - DNA, 74 bp, Artificial
  Synthetic
cactcatccacaagcaacaagcaacaacaaaacacatcaacttacaacccaacacaatctcttcaattacatcc

SEQ ID NO: 6577 - DNA, 652 bp, Artificial
  Synthetic
cccacgcgtccgcggacgcgtgggaaaaaaatcctcctcgccttcgacagcagcagcaaccagcttagctaggctagccatggacgccgccggagccggagcgggtgggaagttgaagaagggagccgccgggaggaaggccggtgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgccgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccgggaagtcccccaagaaggcctaggcgtcggcgcctcgctttgcttgtttagctggagtagattggacgggatgtgtgtctgttagtagtctgctgatgctgttgatctaatctata

SEQ ID NO: 6578 - DNA, 678 bp, Artificial
  Synthetic
cactatccacgctgcacgtttaccattccgacatttgccgcatctcgcaccttacatctactttcgagtaatttttcgttaacccaaaaaccaacttcaaaatgactggcggcggcaaatctggcggcaaggcctctggctccaagaacgctcaatcccgatcctccaaggcgggtcttgcgttccccgttggtcgtgtccaccgtcttctccgaaagggcaactacgctcagcgtgtcggtgccggtgctcccgtctacctcgctgccgttctcgagtacctcgctgccgaaatcctcgagttggctggtaacgccgctcgtgacaacaagaagacccgtatcatccctcgtcacctccagctcgccatccgaaacgatgaggagttgaacaagctgctgggacacgtcaccatcgctcagggtggtgttctgcccaacatccaccagaacctcctccccaagaagacgactggcaagactggcaagggttccagccaagaattgtaattttttcgttggtcgtttgcgctttctttcgaggtcgttttggttgtcataaaggggtcaagggataaggtttacggttgcttttgtacgtctgggttgtacattaatcccccacggctatgatcatgaatcaattagggtttttttcaaatgcacttcattaaaacgt

SEQ ID NO: 6579 - DNA, 559 bp, Artificial
  Synthetic
ggggaagaggcagtggcggcggggcgaagggcgggagccggaagaagtccgtgacgaagaccacgaaggccggcttgcagttcccggtcggccgggtcgcccgctacctcaagaagggccggtatgcgcagcgtattgggtccggtgcccccgtctacctcgccgctgtcatggagtacctcactgccgaggtcctggagctctctgggaacgccgccagggacaacaagaagtcgcgcatcgtcccgcgccacatccagctcgccgtcaggaacgacgacgagttgtcgaagcttctcggcggggtgaccattgctcacggcggcgtcctccccaacatccattctgctctcctccccaagaagagctcctcctcctcggccgcccccggccccgaggagaagcccaagaagacccccaaatctccctctaagccgaagcctgccaaggagtagagagagagagagagagcggagctgagctgagcaggatcagatttgtgccaccttttccttcttcctcaaggtgtctctcaatgtcatctgtatatgcatgctct

SEQ ID NO: 6580 - DNA, 542 bp, Artificial
  Synthetic
gggaaaaatgtcggggtgcgggaggaaggaaggggaagaagaaggcgacgtccaaatcgaccagggctggtgctacagttcccggttggaagattggctcgctacctcaagaatgggaggtatgccaagcgcgtcggcagtggagcgcccgtctatctcgccgcggttctcgagtacctcgccgcagaggttttggagctggccggcaatgctgctcgggacaacaagaagtctagaataatcccgagacacatccagctcgcgatccggaacgacgacgagttggggaagcttctccagggcgtgacgatcgcgtatgggggcgtgattccacacattcatgccgtgcttctccccaagaaatccagctcctcttccaccgccgccgccgattccaaggccgcggagaagagccctaaggccgagaaggccgagaaggcggccaagtagcattcttcctgaagaagagagaggaaactactctttgactctttgtattatatctaatcacaacgactttattgaaaaacaaaaaacacaac

SEQ ID NO: 6581 - DNA, 673 bp, Artificial
  Synthetic
cacgcgtcgcgaatcacgccgcgccgcctcttgacctagcgccgccgccgctgccgctgccccttctcgccgccggcttcttcttcttcttccttgtgtagcgcgtgcgcctctcctctcctctcgtcggcgagtgatatggcgggacgtgggaaggcgatcggcgcgggggccgcgaagaaggcgacgtcgaggagctccaaggccgggctgcagttccccgtgggcaggatcgcgaggttcctcaaggccgggaagtacgccgagcgcgtcggcgccggggcccccgtctacctcgccgccgtcctcgagtacctcgccgctgaggtgctcgagctcgccgggaacgcggcgagggacaacaagaagacccgcatcgtgccgcgccacatccagctcgcggtgcgcaacgacgaggagttgaccaagctgctcggcggcgccaccatcgccagcggcggcgtgatgcccaacatccaccagcacctcctccccaagaaggccgggtcatccaaggcatccaccgtcgacgacgacgacaactaggccgcccgggcgccttctgcattagtaggatcttttgctagctgttcgtctggatttgcattgtgttgttgcgctgagcagtaggaaggggaaaaagagagagagaagttcttggttggtggtttgg

SEQ ID NO: 6582 - DNA, 565 bp, Artificial
  Synthetic
acttttatttccactcctcactaacacttttatctaacaacaacaacaacacacaatgtcttccggtggaaagtccggtggcaaggccgcctcctcttctaagacctccaagtctcgatccgctaaggccgatcttaccttccccgttggtcgagtccaccgactcctgcgaaagggaaactacgcccagcgaattggtgctggtgcccccatctacctcgctgccgtccttgagtacctcgccgtcgagattctcgagctgtccggtaacgctgcccgagacaacaagaagagtcgtatcgttccccgacatctgcagctcgccatccgaaacgatgaggagctgaacaagctgcttggccacgtcaccattgctcagggtggtgttctccccaacatccaccagaaccttctgccccgaaagtccgccaagggcgccaagggtgcttctcaggagctctaagtctcttgaaggctttatattttatctattgggttaagggttgttttaatgtccattaaaactgtttacagtgtactataatgaatgacatgtattgtattt

SEQ ID NO: 6583 - DNA, 687 bp, Artificial
  Synthetic
ccccggcgcactcgcattcgacgacccaagaaaaggaaaaaaaaagaaaaacaatcctccacgccttcgagcgcagcaggaaccagcttagctagactagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaac

SEQ ID NO: 6584 - DNA, 703 bp, Artificial
  Synthetic
gccattacggccggggactcaacactcaaattacaatccaaaagcttatattttttctgttacttctctgtactcaagctttgttaacagttcgttcacaacaatggaagcagcaaccaagacgaccaaaggtgccggaggaaggaaaggcggaggcccaagaaagaaggctgtaaccaaatctgtcaaggctggtcttcagttcccagttggtcgtattgctcgtttcctgaagaagggtcgttatgctcagcgtgttggaagtggtgctccaatttacctcgctgctgttcttgaataccttgctgctgaggtgttggagttggctggaaatgcagcgagagataataagaaaagtaggattgttcctaggcatgtacttttggcagtaaggaatgatgaagagttggggaaattgctgagtggagttaccattgcaagtggaggtgttcttccaaacattaacccagtcttgttgccaaagaaatctgctgcagccgaggagaaggcatcaacgcccaggtccaccaagtcgccaaagaaggcgtaggactatcaattacaattgatcttttggtaaaatatggcgggccactcttttgtctagtttattggtactacttcttgtagtaggacgtagattattagttttctaaattcagtgtaatggtgcttggaaatataatagaaagtaactcttttt

SEQ ID NO: 6585 - DNA, 655 bp, Artificial
  Synthetic
caacaatcaactataatatcaattctttttcaccaatcacaactttgctctttctcatttccaaatggatactgccgggaaagcaaaaaagggtgccggcggcagaaaggctggtggccaatcgaagaagccggtttctcggtccgtcaaagccggtcttcaattcccggtcggtagaattggtcgttatctgaagaagggtcgttacgctcaacgcgttggaagtggtgctccggtttatttggctgctgttcttgagtatttggccgctgaagtgttggaattggctggaaatgcagcgcgtgacaacaagaagaacagaattattccaaggcatgttctgttggctgtgaggaacgatgaagagctagggaagcttcttgctggtgtgacaattgctcatggtggtgtgcttccaaatatcaacccgattttgttgcctaagaaaactggcggagctgaaaaggaaccgaaatctcctgctaaggccacaaaatctcccaggaaagctgtagcttagaccttttaagtgactgctgaaactcaaacttcttttggtttgtttttcttttgtatgtaattgtaatttttgaactttgtgcccgtgccagttgttcttcatagtcaaatcattgaaaccccttgtttctaaaaa

SEQ ID NO: 6586 - DNA, 654 bp, Artificial
  Synthetic
ggacactaccttaaacatgcgttcaacaacagcaaccaaatcggtgggtggcagaggaaaactccaaaaagctacaaaatccatctccagatctcaaaaggcgggtctccaattccctgttggccgagttgctcggtttttgaaaaagggtcgttatgctcagcgagttggctccggttcaccggtttatctctcagcggttcttgagtaccttactgctgagttgttggaacttgctgggaatgctgcaagagacaacaagaagaacagaattgttcctaggcatatacagcttgctgtgaggaacgatgaggaattgagcaggttgttgggatctgctaccattgctaatggtggtgttttgcccaatattcaccagaatttgcttcctaagaagattggcaaagggaaacctgaagtgggttccgcttcacaggaattttagatctttaggtgttgtattaagggattgggtagtgaaattttatttgttcataatggttcaaacgtggggatgtagctcaaatggtggagcgctcgctttgcatgcaagaggcacgggcggggttcgatcccccgcatctccatattttttggtttctgcaatttcgtttttcctcagcatttttctcgaagcaaagtcgtctttacact

SEQ ID NO: 6587 - DNA, 636 bp, Artificial
  Synthetic
gaattcaggaggaaaggttggaaggggaggaagaaaaggtggtgatagaaagaaagcagtaacaaaatcagtcaaagctggactacaattcccagttggtagaatcactcgtttcttgaagaaaggtcgttatgctcaacgtgttggttccggtgctcctgtttatctcgcggccgttcttgaatatctagctgccgaggttttggaattggctggaaatgctgctagggataacaagaaatcaaggattgtaccaaggcatttacttttagcagtaaggaacgatgaagaattaggaaagttgcttgctggtgttactattgctagtggtggtgttcttccaaatatcaactctgttttgttgccaaagaagggtcttgagaaggaatctacacccaaatctcctgccggaaaatctccaaggaaagctgctgcctaaatgatagatctagtttgctttaacttgtccgagtacagtctattatgtaatgtaatgaaatctagggactcttggatcatgttagtgtttgaatgatctgttttttttggggttagttttatgattgaaatcagtttcgggtttcaatgttcatatggtttgttggaatatagctaatcaatggaatcaaaaaaaaa

SEQ ID NO: 6588 - DNA, 699 bp, Artificial
  Synthetic
cggacgcgtgggcaagttttccttcaaatcattcatcatttttgtctaaattctattatctgcaaatggataccagcggaaaagctaagaaaggcgcggccggaagaagaggcggcggtccaaagaagaagccggttacccggtccgtgagagccggtcttcagttcccagtcggtagaattggtcgttacctgaaaaaaggccgatacgcccagcgcgttggtactggtgctcccgtttacttggctgctgtgcttgaatacttggccgctgaagtgttggaattggctggaaatgcggcacgtgacaacaagaagaacaggattatcccacggcatgtgcttttagctgtgaggaatgatgaagagttagggaagttgcttgctggtgtgacaattgcacatggtggtgttcttcccaacattaacccaattttgttgcctaagaagaccggaagtgacaaggcgggcaaagatcctaaatctccttccaaagctaccaaatctcctaagaaggcttagatttaatgtctgttacaagccttttgtttttctatgtttacttggatcttcactgtatgtaattcttgttttagaatgtgtttgattttcctgttgaaaagggaattagttggaattgctagatcttattaggttgtcctctattatcaatcaatgaaaccccttgtttcgaatttaa

SEQ ID NO: 6589 - DNA, 672 bp, Artificial
  Synthetic
tcgcaatccaaaagcttcaatttttcctaatacttctctgtattcaagcttcgtaaactttcattcacatcaatggacgcagcaacaaagacaaccaaaggtgccgctggaaggaaaggaggaggcccaagaaagaaggctgtaaccaaatcaatcaaagctggtcttcagttcccagttggtcgtattgctcgtttcttgaagaaaggtcgttatgctcagcgtgttggatctggtgctccaatttacctcgcagctgttcttgaataccttgctgctgaggtgttggagttggctggaaatgcggccagagataacaagaagagtaggattattcctaggcatgtgcttttggcagtgaggaatgatgaagagttggggaaattgctgagtggagttaccattgcaagtggaggtgttcttcctaacattaacccagtcttgttgcctaagaaaactgctgcagtcgaggagaaggcatctaaacccaaggccactaagtcaccaaagaaggcctaggactatctattagaaatgatcttttcgttaaacatggtgaaccagtcttttgtctaatttattggtactacttcttgtagtaggacgtagattattagttttctaattttggtgtagtggtgcttggaaatataatagaaagcaactcttttt

SEQ ID NO: 6590 - DNA, 554 bp, Artificial
  Synthetic
tctccctctctcatctgcgcatctcttgtcggagaagctaactctctaaccctagctatggccgctggagggggaggtcgtggcaagcctgccggaaagaagtccgtctctcgtagcaacaaggcgggcctgcagtttcctgttggtcgaattgcccgcttcctgaaggctgggaagtatgcagagagagttggggcgggggcccctgtctaccttgcagctgtccttgagtacctcactgcggaagtcctggagcttgctgggaatgctgcgcgggacaacaagaagaacaggatagtcccccgccacatccagcttgctgtgaggaatgatgaggagcttagcaagctccttggccaggtcactattgccaatggaggtgtcctccccaatatccataatgtcctccttcccaagaaagcaggatcgagctccaaggtggcggcagcagattctgaagcctgaaaagggggaaaaaaaaagaagacttactgaagaaacttggtgtttgttgacaccactgatgctctgtgaagatttaggctctgagaatg

SEQ ID NO: 6591 - DNA, 583 bp, Artificial
  Synthetic
tcgaaatctcatctctctgtaaaacaaaatccatttaattcctgtgtttaacagtaacaacaatcaaatggcaggtagaggaaaaaccctaggatctggagcagcaaagaaggctacatcccgtagtagcaaagccggccttcaattccccgtcggtcgtatcgcccgttttctcaaagccgggaaatatgccgagcgtgttggtgccggtgcccctgtttaccttgctgccgtcctcgaataccttgctgctgaggtgcttgaattggctggaaatgctgcgagggacaacaagaagactaggatagtaccaaggcatatacagttggcagtcagaaatgatgaggaattgagcaagttgcttggagatgtaactattgccaatggtggtgttatgcccaatattcataaccttttgctgcctaagaaagctgctggctcctcaaagccatctgctgatgaagattagattggaaggacaataggcagtttcaagtgttaagccttaaatttggatctgctggtgtttgttttttagattccatagaaattattaggtttctccagtatgaaatcaattgtg

SEQ ID NO: 6592 - DNA, 825 bp, Artificial
  Synthetic
gggcaaaatcacagcacaacacaacacttctcctaattatttcgagttttgtagaggttagaaatggagaagaagggagctggaggaagaaagggtggtccaaagaagaaggctgtttcccgttccgttaaggccggtttgcagtttccggtaggtagaattgggcgttacttgaaaaagggtcgatatgctcagcgtgttgggagtggtgctcctgtttatctttctgctgttcttgagtaccttgctgctgaggttttagagttggctggaaatgcagcgagggacaacaagaagactaggataataccgaggcatgttttgttagctgtaaggaatgacgaagagcttggaaaacttctagctggtgtaacaattgctcatggaggtgttcttcctaacatcaatccagttcttctgcctaataaatccgacaaagttggaaaagaacctactaaatcgccaacgaaggctaccaagtcacccaagaaggcctaatttgtgacgatgcaggctcgtgtgatggcacagtgttctacttgaatccatgttgtatggacattgtattgtagctttgcaattaggagctttaatggtggtcgtgaaataatctctacttgtatgtagttttggtatctatgggttgcattgcatgtaggcaaagtatgttgaaaactaggaatgtttgatttctgttattatgatgtgaaactaatgaaattggttctgtttctcaagatctttaatggtggttacatgtgagaattaaaagcttttattgtcttatgagcttttaatttgaattaaattggcaaatgtttatgg

SEQ ID NO: 6593 - DNA, 719 bp, Artificial
  Synthetic
tggtatgaacgcagagtggccattcgccgggggcccacattacagagaaattcaattctttcaagcacaaagcaaagattgttgttttacagtaacaaaatagtattaatggctggtagaggaaaaaccctaggttccggtgctgcaaagaaagctacgtcccgtagcagcaaagccggtctccaattccccgttggtcgtatcgcccgtttcctcaaagccggcaagtatgccgagcgtgtcggcgccggcgctcccgtttaccttgctgccgtccttgagtaccttgcagctgaggtacttgaattggctggaaatgcggcgagggataacaagaagacgaggattgtaccaaggcatattcagttggctgtgagaaacgatgaggaattgagcaagttgcttggagatgtgacaattgctaatggtggtgttatgcccaacattcacaaccttttgctgcctaagaagactggtggatcctcaaagccctctgctgatgaggattaaatagatggccaatttggaattgagagctatatgatgtttttgttagtctatagagagatttagatcatgaaattaagcccccacccccaaatgtggaatgttatttccttagttctgctagttgtcaaggtttatgttagtatgtgaatacaaattaagggatgtatgaaaacatctttttttgatttttgaattctatctgttccagt

SEQ ID NO: 6594 - DNA, 711 bp, Artificial
  Synthetic
gacaaccaattttttccttcaaaatcattcatcatcctgctctaaattcttctatcttcaaatggatactagcggcaaagcgaagaaaggtgcagccggaagaagaggcggtggtccaaagaagaagccggttacccggtccgtgagagccggtcttcagttcccggtcggtagaatcggtcggtacctgaaaaaaggccgttacgctcaacgtgttggtactggtgctcccgtttacttggctgctgttctcgaatatttggctgctgaagtgttggagttggctggaaatgcggcacgtgacaacaagaagaacaggattatcccaaggcatgtgcttttggctgtgaggaatgatgaagagttagggaagttgcttgctggcgtgacaattgcacatggtggcgttcttcccaacattaacccaattttattgcctaagaagactggaggtgataaggctggaaaagaacctaaatctccttccaaaactaccaaatctcctaagaaggcttagatttagtggttgtaatagccttttgtttttctatctttatttaaatatttactgtatctaactgtgctgttagaatgtgttcaatcgttcttcggggatgaaaaaatggaattagttggaacttggaactgttggaccttattaagaggttgtgttctattgtcaatcaatgaagccccgtgtttcgaatttac

SEQ ID NO: 6595 - DNA, 583 bp, Artificial
  Synthetic
gccattacggccggggataccgggaaaacaattcaaatttgaacacgtcaacatgccttcaacaacagcaaccaaatcggtgggtggtagaggaaaactccaaaaagctacaaaatccatctccagatctcaaaaggcgggtctccaattccctgttggccgagttgctcggtttttgaaaaagggtcgttatgctcagcgagttggctccggttcaccggtttatctctcagcggttcttgagtaccttactgctgagttgttggaacttgctgggaatgctgcaagagacaacaaggagaacagaattgttcctaggcatatacagcttgctgtgaggaacgatgaggaattgagcaagttgttggggtctgcaacaattgctaatggtggggttctgcccaatattcaccagaatttgcttcctaagaagattggcaaagggaaacctgaaattagctctgtttctcaggaattttagatatgtaggtgttgtattaagggattgggtagtgaacttttatttgttcataatggttcatgtgaatgacaagtttgtaccctaatcctattaagttgacgt

SEQ ID NO: 6596 - DNA, 404 bp, Artificial
  Synthetic
gcagcatggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttggagatgtgacaattgctaatggaggagtgatgcctaacatccacaatctccttctccccaagaaggctggttcatctaagcctactgaagaagattagtaa

SEQ ID NO: 6597 - DNA, 494 bp, Artificial
  Synthetic
gatcaacatgagttctaccggagaaataaaatctgtagggggtagaggaaaggccaaaggttcaaaaaaatccgtctcgagatctctaaaagcaggtcttcaattcccagttggtcgtattgctcgttatctgaaaaagggtcgttacgctcagcgtcttggctctggttcaccaatttacctctctgctgttcttgaatatcttgctgctgaggtgttagagcttgctggaaatgctgctagagataataagaagactaggatagttccaaggcatatacagcttgcggtgaggaatgacgaggaactcagtaagttgttggggaaggtgacaattgctaatggtggagttttgcccaaaattcatccaaatttgttgcctaataagaatggcaaggggaaactagaagctggaacccagtcacaggaattttagattatggggttaaatcagtttgttgggtagacaggtttaatgtgttttttgtggatta

SEQ ID NO: 6598 - DNA, 688 bp, Artificial
  Synthetic
ccgaaatatcatatcatgcgctaattaaacatacttaggcaaaagccaaatatacttagctttaaaacctaatttgatccccaaaaaacaccatcagggtctattttacaagttccgaatccaaacaagagaactgaactaagaagtctaagaacctcagaactcctgagaagcagatccaatatctcctttgttcttgccaaccttggatggcaaaagagtctgatgaatatttggcaaaactcctccattcgcaatcgtcacacttcccagaagtttgcttaactcttcatcgttcctcactgcaagctgaatgtgtcttggtactatacgtgtcttcttgttatcccttgctgcgtttcccgccagctccaacacctcggcggcgaggtactcgagaacagcggagagatagaccggagctccggcaccgacacgctcggcgtatttaccggatttgaggaatctagcgattcttccgacggggaattgaagaccggctttagatgatcgagagacggatttggtggcctttggctttcctctgccacctttggttgttccgcttcctgcgcctgtactcatcgtcttcttcgaaatttagaacagataaacgatttgatgagagtttgaagaaatcgaagagaaatgactattgtagatgatctccgaattgcggacgcgtggg

SEQ ID NO: 6599 - DNA, 624 bp, Artificial
  Synthetic
ccctcgaccacgcgtccgcaagcagcagttgattatctcagctgactttcccacaaatcgagagttagggttagggttttgtgtttcatctgaaaatgagttctgatggaggatcgggtaagggcaagggtggcgcaggtagaggaaaacctaaggcatcaaaatcggtgtctcggtcttcaaaagcggggctacaattccccgttggtaggatcgctcgtttccttaaggctggaaagtatgctgaacgtgttggtgctggtgcgccagtttacctatctgctgtccttgaatacctagcagctgaggtgttagagttggcagggaatgcagcaagggataacaagaagaatcgtattgtgccgaggcacattcagttggctgtgaggaatgatgaggagctgagcaagcttttgggtcaagttactattgccaatggaggtgttttgcccaacattcaccagaatcttttgcctaagaaagctggctctgggaagggtgatattggctctgcatcccaggagttttagatgtaaaaatgaagcttttgttttcctaaaggattaggggaaatgagtagacttcctttatgtaatatataaaaataccctttctagtttgtta

SEQ ID NO: 6600 - DNA, 380 bp, Artificial
  Synthetic
gccgcttctccctacagccgacccggtgggctctctctcactctctcctccctctccggtccaaccgccagactttcgctccataacccatcatggccccctcatcgcttgctcgccccatgctccgctcgccggccctgcgccagcttgccttccgccgcttcgagagctctgccgccagcaaggccaccgacgccggcaaagatgctgccggcaaggccaaggagtaccaggcaaaggctgcgcaggggctgtcgcgcgtcgcgggtgctgccggccctgccattgccggagctgctcgtggcctcaccaacgcgctcgggaaggtcggtggacgcaccggcaagctcatcagcttcgttgagaagcaaacccctcag

SEQ ID NO: 6601 - DNA, 518 bp, Artificial; identical to SEQ ID NO: 4433
  Synthetic

SEQ ID NO: 6602 - DNA, 606 bp, Artificial
  Synthetic
actccttgcgagggaatagcatcaaacgacgagagcgtcattactagtcgaccaacaaagtcctctccatcctttttgccttcatcctcgccttttcactcctcgactctcgcccatcatgcctgctaagaagctccgttgcaccgccaaggactgccgagagcccgctcagcgcatcgtgggtgactgcaccttttgcaacggccacttctgcggcaagcaccgtttgttggaggaccacaagtgcagcggtctggaagacgtacgtttcatctctgtttcctccccaggtcttttttattttcctcagctaacgcttggcatgcagtgcaagaagcagtctcacgcacgtaatgctgctcagcttgaggctgagcggacgcaagtcatccgaggcgtctaaatcgatatccttgcaactcccccggaatcgccatcatccaacacaaatcgaccgtttaattaccgcaccatctactttactaccattctccttcacatcatgagttgctagccatcgcggcccaattcatactcacggaccatgattacatgaaacaacatattctttcgaggggagagcgaacgggggatgcacagacacag

SEQ ID NO: 6603 - DNA, 771 bp, Artificial
  Synthetic
aaaaggctcaggtttccttgcttcgtcagtcagcggttccatcttgcgtccctttgtgtccttgagtatttaatccacggcgtccggcccccccagtcacttgcctgccatcctcgacaaaacactccttgcgagggaatagcatcaaacgacaagagcgtcattactagtcgaccaacaaagtcctctccatcctttttgccttcatcctcgccttttcactcctcgactctcgcccatcatgcctgctaagaagctccgttgcaccgccaaggactgccgagagcccgctcagcgcatcgtgggtgactgcaccttttgcaacggccacttctgcggcaagcaccgtttgttggaggaccacaagtgcagcggtctggaagactgcaagaagcagtctcacgcacgtaatgctgctcagcttgaggctgagcggacgcaagtcatccgaggcgtctaaatcgatatccttgcaactcccccggaatcgccatcatccaacacaaatcgaccgtttaattaccgcaccatctactttactaccattctccttcacatcatgagttgctagccatcgcggcccaattcatactcacggaccatgattacatgaaacaacatattctttcgaggggagagcgaacgggggatgcacagacacaggcgagagagatttttgcttctttttgccacagaaagagagggaatcaacagaggagagcactataagtgacctctctagttttttgtacatttctaccatttattgtt

SEQ ID NO: 6604 - DNA, 398 bp, Artificial
  Synthetic
cccacgcgtccgtgccatcttttgtcactcatcttcacaggaaacaatggtgtttgtgaagtcctccaaatcgaatgcttacttcaagaggtaccaagtgaagttcaggagaaggagagatgggaagactgattacagggcaaggatccgtcttatcaatcaagacaagaacaagtacaacacccctaagtaccgttttgttgttcgatttaccaacaaagacattgtggcacagattgtatctgcaagcatagctggtgacattgttaaagcttcggcttacgcacatgagcttcctcagtatggactcactgttggtcttaccaactatgctgcagcttactgtactggccttcttttggctcgtcgtgttctgaaaatgctggaaatggatgatg

SEQ ID NO: 6605 - DNA, 711 bp, Artificial
  Synthetic
acgcgtcggcaatccgtcgttggagctcgacaggaggaggaggaggggcagagagacacatccgtcagcggccatggtgttcgtgaaggcgctgaagagcaaggcctacttcaagaggtaccaggtcaagtataaaagacgcagagctggtaagacagactaccgtgctcggatccgtctcacaacccaggataagaacaagtacaacactcctaagtaccgctttgttgttcgatttaccaacaaggatataactgctcagattacatatgcgaccttagctggcgacattgtgcttgctgctgcatatgcacatgagcttccccgctatggcctacccactggcttcaccaactattctgctgcctattgcactggtcttctattggcccgccgtgtcttgaagcaatttgatttggacaaggaatatgttggaaatgaagaggctaccggggaagattacaacattgaagaagctggcgaaaggcgaccattccgggctctgcttgatgttggtctcattcgaaccactacaggaaatcgagtcttcggtgctctcaagggagctttagatggaggtcttgacatcccccacagtgagaagagatttgctggctacagcaaggacgataagtctcttaatgctgacacccacaggaagtacatctttgctgggcatgttgcagactacatgaagatgttgaaagagga

SEQ ID NO: 6606 - DNA, 690 bp, Artificial
  Synthetic
aacaatgtcgttcaacaagattgtcaagacctctgcctaccactctcggttccagacccccttccgtcgacgacgagaaggtaagaccgactactatgctcgaaagcgactcgtgacccagcacaaggccaagtacaacacccccaagtaccgacttgttgtgcgattcaccaacaaggacatcatcgcccagattgtctcttcccagctcaagggtgacattgttttcactgccgcctacgctcacgagcttccccgatacggtgtcaagcacggtcttaccaactgggccgctgcctacgccgtcggtcttcttgttgctcgacgagctctcaagaagctcggcctcgacgagacctacaagggagttgaggaggttgagggtgagtttgagctcaccgaggccgttgaggacggtcctcgacccttcaaggtcttccttgatgtcggtatgacccgaaccaccaccggtgccaagtgcttcggtgttctcaagggtgcttccgatggtggactttacgtcccccactccgcttctcgattccccggttgggatatcgagtccgaggagctcgactccgagaccctgcgaaagtacatcttcgctggccacgtttccgagtacatggaggagcttgccgatgatgatgaggagcgattccgacagatcttccagtcttacctcgacga

SEQ ID NO: 6607 - DNA, 644 bp, Artificial
  Synthetic
gcaggccgagcagcgcagccatggccgtcgccaaggcgcagaaatccaaatcctactacaagcgctaccaggtcaagtaccgccgccggcgagagggtaagaccgattaccgcgcgcgggtgcgattgacaaaccaggacaagaacaaatacaatacaccaaagtatcgatatgttgtgcgcttcacgaacaaggacattgtcgcccagcgtcgcttatgcaactattgctggcgatgtgatcatggccgcggcctactcgcatgaactcccacgatacggtctcaaggtcggcctgacgaactacgcagctgcctactgcactggcctgctcttggcaaggaggttgctcacgaaaatggggatggccgacctttacgagggaaacgatgacgtaaacggtgaggactacaacgtcgaggccgtcgatgataacagacgtccattccgggctcttcttgacgtcggtcttgtccggacgacaaccgggaaccgtgtcttagctgccttgaagggtgcgctggacggtggcctcgatatcccgcacaatgagaagcgcttcgccggatacagcaaggaggacaagtccctgaacgctgaggttcaccggaagtacatctttggcgggcatgtcgctgcgtacat

SEQ ID NO: 6608 - DNA, 544 bp, Artificial
  Synthetic
gccattacggccggggacaacagcttcctttcactccccgcaacccctaacgccggcggcggaggctaatcgaagaacaacaatggccttcatcaaagtccagaagacgagggcttactttaagcgtttccaggttaaattcaagagaaggagagagggaaagactgactatacagccaggaatcggctgatcaatcaggacaaaaataagtacaacacaccaaaataccgctgtgttgaccgatttactaataaggacattatcgcacaaattgtgtctgctagcattgctggtgacatgattcttgcctctgcctatgctcgtgagttgcctcgttatggacttaaagtcggactgacaaactatgctgctgcatactgtactggacttctcttggctagactagttctcaaaaagcttgaaatggacgaagagtatgaagggaacctcgatgtcaatggggaagattactccgttgaacctgctgaaagcaggaggcctttccgtgctctcttggatggtggccttataagaactaccaca

SEQ ID NO: 6609 - DNA, 881 bp, Artificial
  Synthetic
cacgcccttaaccccccgccgccggaggctaatccaggaggaacaatggcattcatcaaagtccagaagactagggcttactttaagcgtttccaggttaaattcaagagaaggagagaggggaagactgactacagagcaaggaatcgcctgattaatcaggacaaaaacaagtacaacactccaaaatatcgtttcgttgtccgatttactaacagggacataatcgcccaaattgtgtctgctagcatagctggtgacatgattcttgcttctgcatatgctcatgagctacctcagtatggcctcaaagctggactgacaaattatgctgctgcttactgtactggacttctcttggcaagacgagttctcaagaaacttgaaatggatgaggagtatcaagggaaccctgaggctactggagaggattactcagttgaacccgctgaaagcaggaggccgttccgtgctctcttggatgtgggccttattagaactactactggaaatcgtgtttttggtgctctaaagggtgcattggatggtggacttgatattcctcatagcgaaaagaggtttgctgggttcagcaaggactccaagcaacttgatgctgatgttcaccgcaagtacatctatggtggccatgttgcaacatatatgaagacgttgactgaagatgagcctgagaaatttcagtctcactttagtgagtacatcaagcaaggtcttgaggctgatgatctcgaggagatgtacaagaaggttcatgctgccatacgtgccgatccaagcccaaagaaatctgagaagcagcctcccaagcagcacaagaggtacaacctgaagaagctgacttatgaggaaaggaaggccaa

SEQ ID NO: 6610 - DNA, 725 bp, Artificial
  Synthetic
cccccgaggaggcatccaagccaagaagagggagagcaccaaggacacgcgactagcagaagccgagcgaccgccttctcgatccatatcttccggtcgagttcttggtcgatctcttccctcctccacctcctcctcacaggttcttggtgtagcttgccactttcaccagcaaagtttcatgtctgatctcgacattcagatcccaactgccttcgatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtcattcaacttcagggtgatcagaggaagaacgtatcaaattttcttgttcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttatccgtgtgttgaagtttgtaagaggcaccatcactatagatgatggcttgtgtccctctttcatcaaga

SEQ ID NO: 6611 - DNA, 783 bp, Artificial
  Synthetic
gcgccagcgcatttaaaaagctcgtcgagtcaccgcataaaaaaaaacacacaaaaggcgctcagcccctctccccgccgaccctttttttccctgtcccgcatcaccaaaaaccaaaacacctcagagaccgtcgcctttcgcagccgccggttcatcaacctcgcctcccccaaactttcctttttcccacgagaaaccccggaacatccgagtttatgtccatcgaaaatctcaagtccttcgaccccttcgccgaagccgacgacgacaccggtgatatcaaaaaggtcgagaaccatatccatattcgtattcaacagcgaaatggtcgcaagtctctgaccacggttactggtcttcctgctaaatttgaccccggcaagattctcaccttcttcaggaaggaattcgcttgcaatggcaacaaggtcaatgatgaaaaggccggcgaggtgatccagctccagggcgaccaacgcaagaaggtcatggatttcctcgttgacaagaagagcggtctcggtctcaaccccgataacatcaccgttcacggtgcctaaatcgtcctctttcgcgccgccgccccggcccgcccttccagcgacttggcttcacagcatgctggtgatgagcgtgtcggaatggggctgctcgagcagcctgtaaccttacacagacgcctaccgcaacctccatcgtctagtcgagaccgctgaacgtccatcctttgctgggggctgcgagcggtctcgtgtgataggaggccctctccggtacaat

SEQ ID NO: 6612 - DNA, 618 bp, Artificial
  Synthetic
ggaggagagagagaagaggtggtgttctctgtcctctgttctctgatctcttgggtcttcttcaaactctctttcatgtccgacctcgagattcaagtcccctctccctttgatccgttcaaggaatcggatgacagcagcacccctgggacagggtccaaggactacatccacattcggatccagcaaagaaatggtcgaaagagcttgaccacagtgcagggcctcaggaaggaattcaattacaaccgcatcctcaaagacttcaagaaggaattctgctgcaatggaaccgtggtcgaagatcctgagctgggccaggtgattcagcttcaaggagatcaaaggaagaacgtgtcgcagttcttagtgcaggctggcgttacaaagaaggacctaatcaaagtgcacggattctgaaagcatttcctatcagatgtagtagtcctacaacattataatatatatatatatatatatatatgctcttgttctatccctggtttaatcatgctttagttgtctccaacccccatatgaggggggcggaggctaactgaacttgatccatgactttactattataaaaacatttaagaatgttttctgttaaaaaac

SEQ ID NO: 6613 - DNA, 510 bp, Artificial
  Synthetic
aacaaaaaaacaccctcccccttcactcgacaatctggacataggtctctagatcgcgccaataacagtttatgtctacttctatcgaaaacctcaagtcctttgatcccttcgccgacactggtgacgacgatactcagcctaccaactacatccatatccgtatccagcagcgaaacggacgaaagactctgaccacagtccagggccttcccgaagaatatgacctcaagcgaatcctgaaggttctcaagaaggattttgcctgcaacggaaacatcggcaaggacgaagagcacggtgagattattcagctccagggagaccagcgagacaagattgtcgacttcctgactgccaagcttcagattgacaagaagaccatcaagaagcacggtttctaaatggatcccgccagtatatgtggctcaaacctgcctgacacgactcccatagcggagtgcgatataacgagattaattccaatatctgtgaaaaaaaaaaacaaaa

SEQ ID NO: 6614 - DNA, 630 bp, Artificial
  Synthetic
ggagagaggagagagagaagaggtggttgttctctgtcctctgttctctgatctcttgggtcttcttcaaactctctttcatgtccgacctcgagattcaagtcccctctccctttgatccgttcaaggaatcggatgacagcagcacccctgggacagggtccaaggactacatccacattcggatccagcaaagaaatggtcgaaagagcttgaccacggtgcagggcctcaggaaggaattcaattacaaccgcatcctcaaagacttcaagaaggaattctgctgcaatggaaccgtggtcgaagatcctgagctgggccaggtgattcagcttcaaggagatcaaaggaagaacgtgtcgcagttcttagtgcaggctggcgttacaaagaaggacctaatcaaagtgcacggattctgaaagcatttcctatcagatgtagtagtcctacaacattataatatatatatatatatatatatatgctcttgttctatccctggtttaatcatgctttagttgtctccaacccccatatgaggggggcggaggctaactgaacttgatccatgactttactattataaaaacattttaagaatgttttctgaaaaaaaaaaaacaa

SEQ ID NO: 6615 - DNA, 607 bp, Artificial
  Synthetic
aatttatcatgtgattaattacttatatcctttcaaggaggcagatgagagcagtgggacgcccgggacaggatcgaaggactacgtccatattcgaatccagcaaaggaatggtcgcaagagcctcactacggttcaagggttgcgaaaagagttcaattacaacaagatcctcaaagatttcaagaaagagttttgctgcaatgggactgtagtccaagaccctgagctgggccaggtcatccaacttcaaggagatcaaaggaagaacgtgtctcaattcttagtacaggctggtgtggcaaagaaggagctgatcaaaatccacggcttttgatagtactattggctatggctatatatatatatatatatatatatatatatataatggagatcttttgtttccatatcaataatagattatgataggtaccttcccattctcattaccctccaaggggggcactggttttcattgagcaaaaacatagcattaatgtgagacctctagtgtaatgaatgcatggaggggggttatttgttacatcgcaaaccaaatcatgttaattatcatactatagtatatcaataaagcatgtgataa

SEQ ID NO: 6616 - DNA, 721 bp, Artificial
  Synthetic
ctcctggtcaagtcttatctgccgtcctccctcctctcgccttccgcctcgcgtgcgctccaccaccgaaaaaaaggacaggttccacataaagaccaacgagtaaaagcttgatctgtccggtgccaaccaatcaacaaacaagtttcatgtctgatctcgacgttcagcttccatctgccttcgatccgtttgctgaggcaaatgctgaggactccggcgctggccctggagcaaaggattatgtgcatgtgcgcatccagcagcgcaacggcagaaagagtctaactactgttcagggcttaaagaaggagtacagttacaacaagatcctcaaggatctgaaaaaggagttctgctgcaatggtactgtagtccaagatccagagcttggccaggtcattcagcttcaaggtgatcagcgtaagaatgttgccacgttcctagttcaggctgggattgctaagaaggacaacatcaagattcacggtttctaagctgcctatagatgctcgtatgcaatatcgtgtgctgccagatattgggaagcctctgaagctaccagttactgttctctatatttgaagtcataagactatttgttgctattaaagcgattcttgcttgatgcaagttgtgtcctcattatgcactaccagcatattatgagtatggtttgtctgggatattgtcaatctaataaaagtacttgctatttgac

SEQ ID NO: 6617 - DNA, 569 bp, Artificial
  Synthetic
ggaattttgggtctgttctaatcatcctcatctctccactccttaaccttcagatcaggtctgagcatctaagtttgaagagttgcgcgttctcttgttaccctttttcttcagccaagtttcatgtctgatctcgacctccaagttcctaatgcttttgatccctttgctgaggcaaatgctgataactctggtgcggggacaaaagattatgtgcacatccgtatacaacaaaggaacggtagaaaaagcctgacaactgtgcagggtttgaagaaagaattcagctacaataaaattctgaaggatctcaagaaagaattttgctgcaacggcactgttgtccaggatccagaattggggcaggttattcaacttcagggtgatcagcgaaagaatgtttcaacatttcttgtccaggttggaatagtgaaaaaagagcacatcaagattcatggtttctgattgccatcatcaatcactgcgcagttactatacttgtgtttgttccaaataatgctgctatgaactaagttattgtaaacagtaaacttgctaatgttggctat

SEQ ID NO: 6618 - DNA, 684 bp, Artificial
  Synthetic
tgtatttgcttagacttatccggaatttggggtctgctctatcaccttctctcccaacccaaccttcggatcagcggctctaagcttttcatctgcccaggtctgagcatccaagtttcgagatttgtgtgcgcttgttgtcttctactactcaaccaagtttaatgtctgatctcgacgcccaaattcctactgcttttgatccctttgccgaggcaaatgctgataattctggggctgggtcaaaagattatgtgcacatccgtatacaacaaaggaatggtaggaaaagcctgacaactgtgcaggggttgaagaaagaattcagctacaacaagatactgaaggatctcaagaaagacttttgctgcaatggtactgttgtccaggatcctgaattaggccaggttattcaacttcagggtgaccagcgtaagaatgtttctgcatttcttgtccaggctggaatcgtgaagaaagagcacatcaaaattcacggtttctgattgttatcatcaaccttgctgcacagttatcgtacttgttacgtcagtgccagagatgctatccaaacttagttctagtggaacttgcttgtgtctaatttctgctggtttgatataaaatactgcagttgcttgcttctctatgttctgtatgttgaatatgagttatgctatattt

SEQ ID NO: 6619 - DNA, 676 bp, Artificial
  Synthetic
gcgtcgcccagcgtcgcccagcgtcgattttttctctctcctcactctctttctgttctctctctctctctctctctgcctccccttgcccgtctttcccaaggccaatttcatgtccgagttggagatccaagtccccacccccttcgatcctttcaaggagtcggatgacagcagcacccctgggacagggtcgaatgattacatccacatccgcattcagcagaggaatgggcggaagagcctgacaaccgtgcagggcctcagaaaggagttcaactacaaccgcatcctcaaagatttcaagaaggaattctgctgcaatgggactgtcgtccaggatcctgagctgggacaggtgatccaacttcaaggagatcagagaaagaatgtgtctcagttcttagtgcaggccggcgttgcgaaaaaggacctgatcaaagtgcacggcttctgaaaatatccctcgccccatgtagtaggttatgctagattaatgcaaaattatccccgcatattacttaccattcatcatcctttaggcatgcttcacaaggcagataatctgccttgtgaagttgatcacttaactaaaaaaatatatatttaagaagatgcccccattgtcctatatagtttcaatttgtaattgctctccttgtgttttcggctctat

SEQ ID NO: 6620 - DNA, 492 bp, Artificial
  Synthetic
gactagttctaaataaagaggcccaactaatttatcttttttattttcttatattcttttcagcatctcttctcgctccagatagttacgaaatcttgagcttcttcttcatttcagtttcatgtcagacgcagatattcagattcccggtgcctatgatccgtttgcagaagcaaatgctgaagattctgatgcgggagcaaaggattatattcatgtacgcatacagcaaaggaatgggcggaaaagcttgaccactgttcaaggggtgaagaaagagtacaattacaacaagattttgaaagatttcaagaaggaattctgttgcaatgggacagtggttcaggatcctgagctgggtcaggtaattcagctgcaaggtgaccaaagaaagaatgtttcacaatttcttgtgcaggctggcatggtgaagaaggatttaatcaaacttcatggtttttaagcccccccccatgtagttagttgtgaagt

SEQ ID NO: 6621 - DNA, 586 bp, Artificial
  Synthetic
agcttgatttggtgtattgatcttatttattgtttcaatcttcgataaacctaattcatgtcagaactcgatatccaaatccccacatctttcgacccattcaaggaggcggacgcgaacaatccagggacaggttctcgcgactacatccacatacgcatgcagcagaggaacgggcgtaaatgcctgaccactgttcaaggcctcaaaaaggaattcaactacaacaagatcctgaaggacgtcaagaaggagttctgctgcaatggcacagttgtgcaagactcagaactcggacaagtgatacagttgcaaggagatcagcgaaagaacgtgtaccaattcctcattcaggctggagtatcaaagaaggagaatattaagcttcatggtttttagtcagtcaatgctgccgccagtctgatttattattttgcatgctgtaattttaagcaaataatattcaggttgcaggttatacctggctttgtaattcgaccgcattttaataatcgcgtggtatagctgaaaatatgtactgtggcagcagattttatcataataatatagttacaaatttggttac

SEQ ID NO: 6622 - DNA, 594 bp, Artificial
  Synthetic
tcgctttctaggcccttgtttcatttgagttcaaacgcttcttctcgtctctcgttcagaatttatttcgcgtccttcaaacaactcaaaatgaagtactctgtcgctgccgtctcggcctttgccgccgtcgttctcgccaagcccgagttcctcaactctgctttccaggtccaggagggcaagccttttaccctcgagtactctggctgctcttctggctgcgagattgttctccagactggtgctagcaccaacctgaaggacgtcaaggttcttgcttcttctgccaccggctcctccactaccgtcaccctggaggacattccctctggcatctacagcttcaagatcaccgacaagagcggcgagagcaactacagccagcagttctcctaccagggcagcggcaaggccatctccagcgcctcatctgccaccagcgctgctgagtccaacacggctgctcccacctccgagaccaccacggctgagcccaccagcaccaaggcttcctccaccaaggagcactccaccacgctggtcaagtcaaccactgctcactccaccaccgaggaggcctcgagcaccacc

SEQ ID NO: 6623 - DNA, 653 bp, Artificial
  Synthetic
acgcgtcggagggggtgaggctcgaagctactgcggctgccggaggaggaggaggacctgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactggaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaagaagaaaagcaagcatgttctgcgaaagctaacaaagaggcaggaaggtcagaagcttgactctcatctagaggatcagtttgcaagtggtcgtctcttggcatgcatttcgtcccgcccgggacagtgtggccgagctgatgggtaca

SEQ ID NO: 6624 - DNA, 197 bp, Artificial
  Synthetic
gggcggacgcgtgggcggagcgaggaggaggcgccgcatcgtcgcggatcgatcagtcatgggtatctcccgcgattcgctccacaagaggagggctaccggtggtaagaagaagcaatggaggaagaagagaaaatacgagctggggaggcagccggcgatgaccaaactggcggccaagacggtgcggcgcattc

SEQ ID NO: 6625 - DNA, 878 bp, Artificial
  Synthetic
gccgacaagtcgattgccctggtgagcaccattatcatcagaaaccgcaatcatgggtatctctcgtgactctcgccacaagcgctccgcctccggtgccaagcgcgcctactaccggaagaagcgcgctttcgaggctggccgccagggtgccaacaccaagattggcgccaagcgaatccacaccgtccgcactcgtggtggtaaccacaagtaccgtgccctgcgtctcgactccggcaacttcgcctgggcctccgagggctgcacccgcaagacccgtgtcattgccgtcgcctaccacccttccaacaacgagctggtccgaaccaacaccctgacccgtagcgccatcgtccagatcgacgctgctcctttccgacagtggtacgagtcccactacggccagcccatcggccgtagacgccagaaggcccaggccgccaaggagggcaaggaggtcgaggaggtcaagaagagcaagtccgtcgagaagaagcaggctgctcgctacgccgccaacggcaaggtcgagtccgctgttgagaagcagttcgaggccggtcgtctgtacgccgttgtcaccagccgtcccggccagtccggccgctgtgacggttacgttctggagggtgaggagctggctttctaccagaagaagctgcacaaataaactcacaatggcgtgagttggatggtgttcaaggattttttcgttatcttgggcattttcagggcatgaagagctttctaacacacaaagcatcggaacgggtccatagggaaatgaaaagcttttctgcaatcatgttacttttttcacgttgtttcattcaagtatgataatgatacaagaaacaaaacaattcaacacacct

SEQ ID NO: 6626 - DNA, 690 bp, Artificial
  Synthetic
gggggctaagctctcagcaaccatgggtatctcacgagattctatgcacaagaggcgtgccactggtggcaagaagaaagcttggaggaagaagagaaagtatgaacttggccgccagcctgctaatactaagatctcggctaacaagacagtccgacgaattcgtgtgcgtggtggcaatgtgaagtggagggcactgagattggatacaggaaattattcatggggtagtgaggcagtcacacgcaagactcgtatccttgatgtggtttacaatgcatcaaacaatgaacttgttcgcacacaaactctggtcaagagtgctattgttcaagttgatgctgcgccatttaaacaatggtacctccagcattatggtgttgacattggtaggaagaagaagggccctgctaagaaggaaactactgaagaaggagaaggtgctgctgccgctgcagaggaaactaagaagagcaaccatgttctccggaagattgagacacgtcagaaggatcgtaaacttgatcctcatattgaagagcaatttggtggtggtaggctgttggcctgtatctcttctcgccctggtcaatgtggcagagcagatgggtacattttggagggaaaagagcttgagttctacatgaagaaactacagaagaagaaaggcaaggctggagctggtggtac

SEQ ID NO: 6627 - DNA, 676 bp, Artificial
  Synthetic
gtcagctgcaaacatgggtatctcaagagattctatgcacaagagacgtgccactggtggaaagaagaaagcttggaggaagaagcgaaagtacgaacttggacgccaaccagctaatactaagatctcaagcaacaagacagttagacgaattcgtgttcgtggtggtaatgtgaagtggagggcactgagattggatactggaaactattcatggggtagtgaggcaaccacacgcaagactcgtatccttgatgtggtttacaatgcctcgaataatgaacttgtccgcacacaaacactggtcaagagtgcaattgttcaagttgatgctgcaccgtttaaacagtggtacctccagcattatggtgttgacattggtaggaaaaagaagggagctgctaagaaggaaactactgaggagggagaagctgctgctccagctgaggaagctaagaagagcaaccatgtagcccggaaacttgagaaacgtcagaaggatcgtaaacttgatcctcacctcgaagagcaatttggttctggtaggctatatgcctgcatctcatctcgccctggtcaatgtggcagagctgatgggtacattttggaagggaaagagttggaattctatatgaagaaacttcaaaagaagaaaggcaaggctggatctggtgct

SEQ ID NO: 6628 - DNA, 637 bp, Artificial
  Synthetic
  misc_feature (473)..(473): The residue at this position can be any nucleotide.
gaattcatcaggcaacgcagtcgagaggtttctggttccatctgcaaacatgggtatctctcgtgattctatgcacaaaagacgtgcaactggaggaaagaagaaggcttggaggaagaagcgaaagtacgagctcggaagacagcccgcaaacaccaaactttcgagcaacaaaactgttcgaagagttagggttcgtggaggaaacgtgaaatggagagctcttagactcgatacaggaaatttctcatggggaagtgagactgtgaccaggaaatcccgtcttcttgatgtcgtttacaacgcatctaacaacgagttggttaggactcagactttggtcaagggtgctattgttcaagttgatgctgctccatttaagcaatggtatcttcaacattatggtcttgatattggacgtaagaagaagactactgctgccaagaaagaaggagaggaggctgaggctgtanctgaggaagcaaagaagagcaaccatctcctgaggaaaattgagggtcgtcaagtagatcacaagcttgactcacatattgaagagcaattcagtggtggacgattattggcttgtatctcatctcgccctgggcagtgtggtcgtgctgatggatacattctg

SEQ ID NO: 6629 - DNA, 612 bp, Artificial
  Synthetic
gaattcgggcgcgctacaggaggaaagaaaaagggatggaggaagaagcgaaagtacgagctcggtcgtcagcctgctaacaccaagctgtcaagcaacaagacagtgaggagagtacgtgttagaggaggtaatgtaaagtggagggcactccgattggatactggaaattactcatggggaagtgaaaccgttactcgtaagacccgtcttcttgatgtcgtttacaatgcatcgaacaatgagcttgtcaggacacagacattagtgaagagcgctattgttcaagttgatgctgctcctttcaagcaatggtaccttcagcactatggtcttgacatcggaaggaagaagaagactgctgctgccaagaaggaaaccactgaggagggagaagctgctgcagcagaagaagcaaagaagagtaaccatgtaatcaggaaagttgagaagcgtcaggtggatcacaaacttgaccctcatattgaagagcagtttagtggaggcagactattggcctgcatttcatctcgccctggacaatgtggtagagctgatgggtacatcttggaaggaaaggagcttgaattttacatgaagaagctacaaaag

SEQ ID NO: 6630 - DNA, 666 bp, Artificial
  Synthetic
gctttagggagggggtgaggctcgaagctactgcggctgccggaggaggaggaggacctgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactggaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaagaagaaaagcaagcatgttctgcgaaagctaacaaagaggcaggaaggtcagaagcttgactctcatctagaggatcagtttgcaagtggtcgtctcttggcatgcatttcgtcccgcccgggacagtgtggccgagctgatgggtacattttggaaggaaa

SEQ ID NO: 6631 - DNA, 651 bp, Artificial
  Synthetic
  misc_feature (587)..(587): The residue at this position can be any nucleotide.
gaggttgaggtcgctactcggagcagggccaagatgggtatctctcgtgattcggtacataaaaggcgcgcaactggagggaagaagaaagcatggcgcaagaagagaaagtacgaaatgggaaggcaacctgccatgacaaaactctcaagcaacaaaactgtccgaaggatcagagttcgaggagggaatttcaagttcagggcattgaggctggacacaggaaattactcttggggatctgaggcagccactcgcaaatcaagaatccttgatgttgtctacaatgcctcaaacaatgagctagtgcgaactcaaacccttgtgaaaagtgccatagtacaggttgatgctactcctttcaggcagtggtacaagcaacactatggattggacataggaagaaagaagaaagcttctggaggaaagaaagaagaggatgtagaggcaggggaagaagagaaaaaaataagtaaccatgtgcagcgcaaagttgctaaaagggttgaaggcaataaattagattctcacttagaagaccaatttgcaagtggccgtttattagcctgcatctcatctaggcctgngcagtgtgggcgggctgatggatatatccttgaaggaaaggaacttgagttctatcagaaaaag

SEQ ID NO: 6632 - DNA, 653 bp, Artificial
  Synthetic
gggcggacgcgtgggcggacgcgtgggcttagctgcttttagctctcagcaaccatgggtatctcacgagattctatgcacaaaagacgtgccactggtggcaagaagaaagcttggaggaagaagcgaaagtacgagcttggccgtcaacctgggaatactaagatctcaagtaacaagacagtcagacgaattcgtgttcgtggtggcaatgtgaaatggagagcactgagattggatacaggaaactattcatggggtagtgaagcaaccacccgtaagactcgtatccttgatgtggtatacaatgcctcaaacaatgaacttgttcgcacacaaactctggtgaagagcgcaatcgttcaggttgatgcagcaccttttaaacagtggtacctccagcactacggtgttgacattggtaggaagaagaagggggctgctaagaaagaaactgccgaggagggagaaggtgctgctgctgcagaggaaactaagaagagcaaccatgtagcccgaaaacttgagaaacgccagaaggatcgcaaacttgatgctcaccttgaagaacaatttggtgcgggtaggctgttggcctgcatctcatctcggcccggtcagcgtggcagagctgatgggtatatcttggaggg

SEQ ID NO: 6633 - DNA, 337 bp, Artificial
  Synthetic
cccctccacccacgcgtgcgcttttggagaaaccctaatcggcgacaatgggtatttctcgtgactctatccacaagaggcgtgccactggaggcaagcagaagcaatggaggaagaagcgaaagtatgagatgggaaggcagccagccaacaccaagctctcaagcaacaagacggtcagaagaataagagttcgtggtggaaatgttaagtggcgtgcgttgaggctcgatactggtaactactcgtggggaagtgaagcaactacccgcaagaccagagtccttgatgtggtctacaatgcctccaacaatgagcttgtacgtactaagacact

SEQ ID NO: 6634 - DNA, 711 bp, Artificial
  Synthetic
gccggtaggcagtagtgagcgcagaagcagggagagacacaaaaaatgaagactatactctcatcagaaacgatggatatccccgatggggtgaaaatcaaggtaaaagcaaagcaaatagaagtggagggaccaagaggaaagctaacccgcaacttcaagcacttgaatcttgattttcagctcataaaagatgaagaaactggaaagaaaaagctcaagattgatgcttggtttggatctcgtaaaaccacagctgctattcgcactgctcttagtcacgttgataatctcataactggtgtcacaaaagggtaccgttacaagatgcgttttgtttatgcccattttcctatcaatgcttctatcactggtgggaacaaggctattgagatcaggaactttctgggcgagaaaagggtgaggaaagtcgatatgcttgatggggttactgttgtgaggtctgagaaagttaaggatgaattggtattggatggaaatgacattgagcttgtttctcggtctgctgccctcatcaatcagaaatgccatgtgaagaacaaagatattcgtaagttcctggatggtatctatgtgagtgagaagggaagaatagccgaagaagagtaagttttagcagattggttgggggttgtttggggatcatctgctgatttcatacgaactcatatttgaagttaattcaacaat

SEQ ID NO: 6635 - DNA, 720 bp, Artificial
  Synthetic
gctgctagggttttagcgatcgccattttcacacacacagaaggagagcggaagagagaaactaagacaagatgaagaccattctgtcatcagaaaccatggatatccccgacggcgtgagcatcaaggtgaaggcaaagcaaatcgaagtagagggaccaaggggcaaacttgtccgaaacttcaagcatctcaacctcgattttcagctgatcaaggatgaggaaactggcaagaagaaactgaagatcgacgcttggtttggatctcgtaagactaccgctgctatccgtactgctcttagccatgttgagaatctcatcactggtgttacgaaaggttaccgctacaagatgcgtttcgtgtatgctcactttcccatcaatgcctccatcaccggtggtaacaagtccattgagatccgtaacttccttggcgagaagagggttaggaaagtggacatgcttgatggggttacagttgttcgatctgagaaggtgaaggatgagcttgtattggatggaaatgacattgagctcgtttctcgctctgctgccctcatcaatcaaaaatgccatgtgaagaacaaggatatccgaaagtttcttgatggtatctatgtcagtgagaagggcagaattgcagaagaagaatgagcagctgttttagaagtaggcatatcactgatgattcatatccagaatgccctttttacttttc

SEQ ID NO: 6636 - DNA, 515 bp, Artificial
  Synthetic
cccccccccgcttccttcttcttccacgccgggcatcgccgccgccgccgccgccgccggagagggagagagagagagagagatcgagagcaagagatgaaaacgatcttggcttcggagacgatggagatcccgtcgggggtgacggtgcacgtggcggcgaaggtggtgacggtggagggtccccgtgggaagctgacgcgcaacttcaagcacctgaacctggacttccagctgctggaggtggagggggtgaggaagctgcaggtggacgcgtggttcggcacccgccgcaccatggccgccatccgcaccgccatctcccacgtccagaacctcatcaccggcgtcaccaagggctaccgctacaagatgcgcttcgtctatgcccatttccccatcaacgcctccatcaccaactccaacaccgccatcgagatcaggaacttcctcggcgagaagaaggtgaggaaagtggacatgcttgagggtgtgacaattttgcgttctgagaa

SEQ ID NO: 6637 - DNA, 793 bp, Artificial
  Synthetic
aattcgtgatcgcggaagggacgactccagataccctcaacgccccgacaacccccaagtcacagcagccatgaggtacattcactctcaggagatcctggaaattccagagggcgtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctgttcgaggtggagatccgaaacttcatcggcgagaagatcgtccgacgggttaccatgcacgagggtgtcgatgttgagatctccaaggcccagaaggatgagctcatcctgaccggcaactcactcgagaacgtttcccagagcgccgcagatatccagcagatctgccgggtgcgcaacaaggatatccgaaagttcttggacggtctgtacgtttccgagaagggcaacgttgttgaggaggcttaaatgtaccggacaaggatctctgtttcttttgcgtttctgggactccggagtggcgaaggttcatcattgcatgtcacgtagcaacggggctactcttttacaaaaaatacattaaaaagtattttgtaacaaaaaaaaaaa

SEQ ID NO: 6638 - DNA, 548 bp, Artificial
  Synthetic
gcaatgaagtcatccagtccgacgttctgctcgatatccccgagggtgtcaccgttgacatcaaggcccgacgaatcaccgtcaccggcccccgaggtaccctcaagaagaacctgtctcacatcaacgttgccttcgagaaggtctccgatgaccagatcaagatcaccatcttcgatggtgaccgaaagcacgtcgctgctctgcgaaccgtcaagaccctcatcaacaacatgatcaccggtgtcacccgaggttacaagtacaagatgcgatacgtctacgcccatttccccatcaacgtcaacctcattaaggacggttccgtcgttgagatccgaaacttcctcggtgagaagcgagtccgagaagtccccatccacgagggctgcagcgctgagatctctaccaaccagaaggatgagatctgcatcatcggtaactccatcgagaacgtctctcagacctgtgctgacatccagcagatctggcgagtccgacacaaggatatccgaaagttccttgatggtatctacgtttccgagaat

SEQ ID NO: 6639 - DNA, 625 bp, Artificial
  Synthetic
gggtgcgaggaggaggaggcgggcgcgatgaagacgatcttgtcggcccagacgatggacatccccgagggggtgaaggtagagatccgggcgaagcagatccgggtgacggggccgcggggggtgctgcacaggaatttcaagcacctcaacctcgacttccagctgctggagaatgggcgcaagctcaaggtggaggcgtggtttgggtcgcgcaagaccatcgccgccatccgcaccgccgtgagccacgtgaagaacctcatcaccggcgtcaccaagggcttccagtacaagatgaggtttgtctacgctcacttccccatcaacgccaacatctctgccaccaagcaaaacatcgagatccggaacttcctcggcgagaagagggtgagaactgtcgacatgcttccgggtgtgactgtgaccaggacggagaaggtcaaggacgagcttgttctcgaggggaatgacatcgagcttgtgtcgagatcggccgctctcatcaaccagaaatgccatgtcaagaacaaggatatcaggaagttcttggatggtatctacgtgagcgagaagggaacgatcgctgtggaggagtagacctgttgcctgttctgagtataat

SEQ ID NO: 6640 - DNA, 628 bp, Artificial
  Synthetic
gaattctctgcaaaggattctacccgccaccggggtggtaatagtacttcagggcggcccgcgcagctcgtccgctgcgagggctacgcccacggcacgtgcctctggggacccgaaggtccctactgcaggtcggcaatcgggcgacgggcgcatgcgccgcttctttagcctggattctgacttagaggcgttcagtcataatcctgcacacggtagcttcgcgccactggcttttcaaccaagcgcgatgaccaattgtgtgaatcaacggttcctctcgtactaggttgaattactatcgcggcactgtcatcagtagggtaaaactaacctgtctcacgacggtctaaccccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaagatctaaaggatcgataggccacgctttcacggttcgtattcgtactggaaatcagaatcaaacgagcttttacccttttgttccacacgagatt

SEQ ID NO: 6641 - DNA, 244 bp, Artificial
  Synthetic
aattcggcacgaggacggcgggcgcatgcgtcgcttctagcccggattctgacttagaggcgttcagtcataatccagcgcacggtagcttcgcgccactggcttttcaaccaagcgcgatgaccaattgtgcgaatcaacggttcctctcgtactaggttgaattactattgcgacactgccatcagtagggtaaaactaacctgtctcacgacggactaaacccaactcacgttccctattg

SEQ ID NO: 6642 - DNA, 1889 bp, Artificial
  Synthetic
gcccgccgcccgttgggaagggagcttcgaggcggccggccgcggcgcgtcggccgggccggcttggccggtggcacgggcccttgggggcttgcgcccctaacgtgggtcggggcgggcggcgggcgcaggcgccgcttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcacggtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaactccgaaggtctaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcggcccgagggactcgggccttagagccaaaaggaggggccaggccccgcttccgactcacggaataagtaaaataacgttaaaagtagtggtatttcacttgcgcccgagggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcagcatccgcgaggaccatcgcaatgctttgttttaattaaacagtcggattccccttgtccgtaccagttctgagtcggctgttcgacgcccggggaaggcccccgagggggccgttcccggtccgtcccccggccggcacgcggcggcccgctctcgccgcgcgagcagctcgagcagtccgccggcagccgacgggttcggggccgggacccccgagcccagccctcagagccaatccttttcccgaagttacggatccgttttgccgacttcccttgcctacattgttccattggccagaggctgttcaccttggagacctgatgcggttatgagtacgaccgggcgtggacggtactcggtcctccggattttcaagggccgccgggggcgcaccggacaccgcgcgacgtgcggtgctcttccggccgctggaccctacctccggctgaaccgtttccagggttggcgggccgttaagcagaaaagataactcttcccgaggcccccgccggcgtctccggacttcctaacgtcgccgtcaaccgccacgtcccggctcgggaaatcttaacccgattccctttcggggcacgcgcgtggtcgcgctctctgccggggttaccccgtcccttaggatcggcttacccatgtgcaagtgccgttcacatggaacctttctcctcttcggccttcaaagttctcatttgaatatttgctactaccaccaagatctgcaccgacggccgctccgcccgggctcgcgccccgggttttgcg

SEQ ID NO: 6643 - DNA, 484 bp, Artificial
  Synthetic
cggacgcgtgggcggacgcgtgggcggaattcgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgacagtgtcgcaatagtaattcaacctagtacgagaggaaccgttgattcgcacaattggtcatcgcgcttggttgaaaagccagtggcgcgaagctaccgtgcgctggattatgactgaacgcctctaagtcagaatccgggctagaagcgacgcatgcgcccgccgtccgattgccgacccgcagtaggggcctttggcccccaagggcacgtgtcgttggctaagtcatcgcggcggaag

SEQ ID NO: 6644 - DNA, 314 bp, Artificial
  Synthetic
cgcaggtgtcctattatgagctcattgtgaacagaaatctcgtgtggaacaaaagggtagaagctcgtttgattctgattttcagtacgaatacgaaccgtgaaagcgtggcctatcgatcctttagaccttcggaatttgaatctagaggtgtcagaaaagttaccacagggataactggcttggggcagccaagcgttcatagcgacgttgctttttgatccttcgatgtaggctcttcctatcattgtgaagcataattcaccaagtgttggattgttcacccaccaatagggaacgggaactggggttag

SEQ ID NO: 6645 - DNA, 737 bp, Artificial
  Synthetic
gatcgaggcttgtgccctccacactcatttgtgctcgtcgtcgagaggagacgagaggcgagaggagaggacgcattcttggatctagatcgacaatcagaatgggcaaatcttatcctgcagtgagcgacgagtacctggccgccgtcgacaaggccaagagaaagcttcgcggcttcatcgcagagaagaactgtgccccattgatgcttcgtcttgcatggcattcggccgggactttcgactgtgcgtccaagacgggtggtccctttggaaccatgaagcacgccgaagaactcggccacggcgcgaatgccggcctcgacatcgctatcaagcttctccagccgattaaagaccagtttccggtcctgagctatggcgacttctaccagcttgctggggtcgtcgcagtggagatcactggaggcccggatattccattccatccggggagagtggacagggagacatgccccgtagagggccggcttccagacgcgaccaagggagccgatcatctccgtgacgtttttgtgaagcaaatggggctctctgacaaggacattgtggctctttctggcggtcacactttgggaagagcacacaaggaaaggtcgggttttgagggcccatggacgcacaaccctctccagtttgacaactcctacttcacacttctgctgagcggcgagcaagaaggcatcctgacgctcaagacggacaaggttctggtg

SEQ ID NO: 6646 - DNA, 737 bp, Artificial
  Synthetic
gaggagagggagagaatgccggtgccggtggtggacaatgcgtacctcaaggcgatcgagtcggcgaggcgcgatctccgcgcgttcattgcggagaagaattccgcgccactgatgcttcggttggcatggcacgatgccgggacgtatgatgctgtgtccaagactggaggaccgaatggatcgatccggagcgagcgcgagtatacccacgctgccaacaatgggatcaaaatcgccatagacttttgtgagcctatcaaacagaaatatcccattatcacgtatgctgatctctaccagcttgctggcgttgttgctgtggaagtcactggaggtcctacaataaattttgttcctggccgcaaggaatcggtcgctactacacccgaaggacggcttcccgatgctcatcttggggcaaagcatatccgcgatgtcttctacagaatgggtctatctgacaaagatatcgtcgctctctctggtggtcacacactgggtagaggacacaaggaaaggtctgggtttgagggaccctggacatcacagccattgaagttcgacaactcatacttcacggagcttttgagaggagaatcggaaggcctgttgcagttgccgacagacaagtgcttgcttgaggatccatcgttccgtccatacgtggagctgtatgcaaaggacgaagacgcattcttcaaagattacgccgagtcgcacaagaagctatccga

SEQ ID NO: 6647 - DNA, 627 bp, Artificial
  Synthetic
caagacacactctcaagatgcgatctttccgagcagtccgaaacttctccaccaccgccaagcgcctcagccaggcccccaaggcctccactcctaacgcctcctctggaaacggctttgtgttggcctttgtggcctccgccgctggagccggtgcctactactactacgccaactcccctgccgccaaggtcgagacctttaacgccaccaaggccgactaccagaaggtgtacgacgctattgccgacaagctgattgaggacgacgactatgatgatggatcttacggacccgtcctcctgcgactcgcctggcactcgtctggtacctacaacaagtctgataacaagtttggctcttccggaggtaccatgcgattcaagcccgaggcttctcatgctgccaacaatggcctggttaacgccagaaacttcctcaagcccatccacgagaagttcccttggatctccaccggtgatctgtacactcttggtggtgtcaccgccgtccaggagctcggtggccctatcatcccctggaagcgaggccgtgtcgacgagcccgagtctgcttctcctcccgatggatctcttcccgacgcctctcagggcgctactcatgtgc

SEQ ID NO: 6648 - DNA, 626 bp, Artificial
  Synthetic
tagaactagtcacaccacacgcttggcttgacgccgcacgcctccgctccgctccgccgccgcggccgatctctctagggcttccaacctcgccggcgacgcgacgccacgccatggccgccccggtcgtggacgccgagtacctccgccaggtcgacagggcgcgccgccacctccgcgccctcatctcctccaagggatgcgcgcccatcatgctccgcctcgcatggcatgacgcgggcacttatgacgtgaacacaaaaactggtggtgcaaatggttcaattagatacgaggaagagtacactcacggttcaaatgctggtctaaagattgctattgatcttctcgagcctattaaagccaagagccctaagatcacatatgctgacctttatcagcttgctggagttgttgcagttgaagttactgggggtccaactgttgagttcattcctggaagacgtgattcgtcagtttgcccccgtgaagggcgtcttcctgatgctaagaaaggtgcactgcacttgagggacatcttttaccggatgggcttatcagacaaagatatagtagctttatctgggggtcacactctgggaagggcacatcctgaaaggtctgga

SEQ ID NO: 6649 - DNA, 648 bp, Artificial
  Synthetic
cttatcctcattcacctttcctccagcaatggcgaagccaatcgtcgacacggagtacctcaaagaaattgagaaagctcgtcgcgacctccgcgctctcatctccagcaaaaactgtgctcctatcatgcttcgcttagcatggcacgatgcaggaacgtacgatgctaagtctaagaccggtggaccgaatggttccatcagaaatgaggaagagttcagtcacggtgctaataatggattaaaaatcgctcttgacttttgcgaagcagtgaagtctaaacatcaaatgataacgtatgcagatttgtaccagcttgcaggagttgttgcagttgaagtcactggtggtccgaccattgattttgtccctggtaggaaggattccagtgtttctccaaaggaaggacggctgccagatgctaaacaaggtgtgccacatctgaaagatgtattttataggatgggtttgtctgacaaagatatagtggcactatctggtggtcacacactgggaagggcacatccagatagatcaggctttgatggtccatggacaaaggagccactgaaatttgacaattcatattttgtggagctgcttaagggggaaactgagggcctgctgaaacttgctacagacatagc

SEQ ID NO: 6650 - DNA, 625 bp, Artificial
  Synthetic
aaacttaccgtctccccctttcgtccatttgtgatcgagtaggagagagagagagagagggaggaaagaggaagaagaagaggatggcgcctccagttgtagatgatgcctaccgcggagccatcgggaaggcccgccgtgacctccgcgccttcattgccgagaagaactgcgctcccatcatgctccgccttgcatggcacgatgctggtacctatgatgccaaaacaaaaactggtggtgcaaatggatcaatacgaaatgagaaggaacttctccatggggcaaatagtggtttgaaaatagccattgatttttgtgaaacactgaaggtgaagtatccagctatcacacatgctgacttttaccagctggctggtgttgttgcagttgaggttactggaggacccacagttgaattcattcctggtcgtaaggattccctggtttctccttcggaaggacgccttccagatgcaaataaaggtgcggcacatttgaaggatatattctatcgaatgggtctttcagacaaagatattgtagctctgtcaggggcacatacacttggaagagcacatgtacagaggtctggttttgaaggaccatggacacagcagcccct

SEQ ID NO: 6651 - DNA, 195 bp, Artificial
  Synthetic
gcgcgtagacgcccgcttatccagactctctctctctcaaatcacagtcgaacacgttcttcgcaccatccacagccatgcctcccaagaagaccgaaggtgctgcccccaaggccaagtctggcgctgcccatgccagctaccagctcaaggatcgcaatggctctagccgtcagtctctgaagaagtacgtca

SEQ ID NO: 6652 - DNA, 922 bp, Artificial
  Synthetic
cccacgcgtccgcccacgcgtccgcccacgcgtccgcccacgcgtccgcccacgcgtccgcccacgcgtccgcccacgcgtccgagaaatcaattacaatccctcaatccagtcgcgtcagacgcccgcttatccagactctctctctctcaaatcacagtcgaacacgttcttcgcaccatccacagccatgcctcccaagaagaccgaaggtgctgcccccaaggccaagtctggcgctgcccatgccagctaccaggacatgattacggatgccattctcaatctcaaggatcgcaatggctctagccgtcagtctctgaagaagtacgtcaaggccaacaacaccttgaacgtttcggacaacatgttcgattctctcttcaacaaggccctcaaggccggtgttgagaagggcatcttcgcccagcccaagggcccctctggaggcaccaagctggccaagaagaagcccgaggccaagaaggctgccgctcccaagaaggagaaggacgccactgctaagaaggccactgccaccaagaaggccgccgcccccaagaaggccaaggagggcgccgagaagaaggaaaagaaggagaagaaggagggcgctgccaccaagaaggctgctgctcccaagaaggccaccgccaccgctaagaagaccaaggaggctcccgccaagcccgagaagcctgagaccgttctgaccaagaccaagtccggccgtgttgccaaggcccagaagcccgctgccaccaagaaggccgcaccaaagaaggctgctgctcccaagaaggagaaggctgctgctgccgctcccgcagccgccgctgccaccaaggcgtaattgatctccttggcgtgagcaaaagcagcttttcttttactttttgtatccttgatgaatgtggcacgg

SEQ ID NO: 6653 - DNA, 649 bp, Artificial
  Synthetic
gggttggaggcgccgcggcatggcggaaaagcagaaccccatgcgggacatcaaggtccagaagctcgtcctcaacatctccgtcggcgagagcggcgatcgtctcaccagggccgccaaggtcctggagcagctcagcgggcagcaacctgtcttctccaaggcccggttcacggtccggtcttttggcatccggcgtaacgagaagatcgcttgctacgtgaccgttcggggcgacaaggcgatgcagctactcgagagcgggctcaaggtcaaggaatacgagctgctgcgccgcaacttcagtgacactggatgctttggcttcggcatccaggagcacatcgacctgggcatcaagtacgatccatcgacgggcatttacgggatggatttctacgtagtgctggagcggcctggctaccgcgtcgcgaggaggcggcggtgcaagtccaaggttgggatcaagcaccgggtgaccaaggaggacgccatgaagtggttccagctcaagtacgagggcgtcatcctcaacaagtcccaggccttctgacctgcttgacacataaaaaccaaagccggatgtaacctctcttgtggtgtgttttatatcagcttttttccaatgatctagaaagttttcggtcag

SEQ ID NO: 6654 - DNA, 558 bp, Artificial
  Synthetic
ggggatattgaggaggagagtctgtcgttgtaccaggaggaggaggaggacgagtaggaggaggcctagggtttagtagaagacagcaaccatggtggccgcggagaagaagctgttgaaccccatgagggagatcaaggtgcagaagctcgtcctcaatatctccgttggtgagagtggtgatcgccttaccagggctgctaaggtgttggagcaattgagtggacagacccctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgcaggaatttcagtgacactggttgctttggctttggaattcaggagcacattgatttgggaatcaagtatgacccatcgacaggtatctatggtatggatttctttgtagttctggagaggccaggattcagagttgcgaggagaaagagggcgcaggcacgtgttggcattcagcaaag

SEQ ID NO: 6655 - DNA, 732 bp, Artificial
  Synthetic
gatgcgggagatcaaggtgcagaagctcgtgctcaacatctccgtcggcgagagcggcgacaggctcacccgcgcctccaaggtgttggagcagctgagtgggcagagcccagttttctccaaggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgg

SEQ ID NO: 6656 - DNA, 622 bp, Artificial
  Synthetic
gctcatcctcacatcacatacatcgtccacaatggctgagtcaggcaaggcagttaaccctatgaaggagctccgcatcgacaagcttgtcgtcaacatctccgtcggagagtccggtgacaggctgacccgagccaccaaggtgcttgaacagctcactggtcaatcgccagtcacctccaaggcccgctacaccctccgtggtttcggtatccgacgtaacgagaagatcgcttgccacgtcactgtccgaggaccaaaggcagaggagatcctcgagcgcgcgctcaaggtcaaggagtacgagcttcgacgaggcaacttctccgagactggcaacttcggtttcggtatcactgagcacattgacctcggcattaagtacgacccggccatcggaatcttcggcgccgacttctacgtagtgatgacccgcccaggtgcccgtgtcgctcgccgcaagatgaggacgtcgcgagttggtgccccacaccgtgtaaagaaggaggacaccgccgcttggttcaaggccaagttcgacggtatcatcatgaagtaattgcgcggtgcagcgtgtcacatctgtgtattagttcctgctatcaagcctttctcattgctc

SEQ ID NO: 6657 - DNA, 693 bp, Artificial
  Synthetic
gggccagggatagagaggaggagagtctgtcgttgtaccaggaggaggaggaggacgagtaggaggagtcctagggtttagtagaagacagcaaccatggtggccgcggagaagaagctgttgaaccccatgagggagatcaaggtgcagaagctcgtcctcaatatctccgttggtgagagtggtgatcgccttaccagggctgctaaggtgttggagcaattgagtggacagactcctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgcaggaatttcagtgacactggttgctttggctttggaattcaggagcacattgatttgggaatcaagtatgacccatcgacaggtatctatggtatggatttctttgtagttctggagaggccaggattcagagttgcgaggagaaagagggcgcaggcacgcgttggcattcagcaaagggtaacgaaggaggatgccatgaagtggttccaagtcaaatatgaaggagtcattctcaacaagtcctccaacatcagttagttagttatctatctaactgcctgcaggctttgtaggacaaaattagtg

SEQ ID NO: 6658 - DNA, 404 bp, Artificial
  Synthetic
ctcgagcttgcggccgcaaaaaggttaccacaacacgaaatccttactatccagaatcttaaatataagaacttgaaacaaaacaaaatgacaaaaaaaagctcttcaaccagtgatgttctgagacttgttgaggataactccttcatacttaacttggaaccacttcatggcatcatccttggtaactctatgttgaataccaacgcgagtcttgcatctacggcgacgggccacacggtatcctggacgttcaagaacaacgtagaaatccataccgtagataccggtagaaggatcatacttgattccaagatcaatgtgctcctggataccgaatccgaagcagccagtgtcactgaagttcctcctcaacagctcgtattccttcactttcaagccac

SEQ ID NO: 6659 - DNA, 855 bp, Artificial
  Synthetic
ccccccccatctcattacccaacaactcttccagctactgctgctgttacatcttcctgcggtagcgccatggcttcagagaagaaattgagcaaccccatgagagaaattaaggtccagaagctcgttctcaatatctccgtcggtgagagcggagatcgtctcaccagagcagctaaggtcttggagcagcttagcggccaatcccctgttttctccaaggctaggtatactgtgcggtcttttggaatcaggcgtaatgaaaagatagcttgctatgtaactgtcagaggggagaaagctatgcagctacttgagagtggattgaaagttaaggaatacgagttgttgagaaggaacttcagtgagaccggctgctttgggtttggtattcaggagcacattgatcttggaattaaatatgatccgtcaactggtatttatggcatggacttctatgttgtattggagcgtcctggataccgtgttgcccgtcggcgcaggtgcaagtctcgagttgggattcagcacagagtcacaaaggaggatgcgatgaagtggttccaggtcaaatatgaaggtgttatccttaacaagtcctcaaacattcagtgataagcttagaaagccaacttctggatcagtctgtctcctcgcaagtttatgtttatgtattttgttgacctgcatctatatcactcgtagagggaagttttggagagtttctagtagtggcgtatgaggatgttttagttctcattttggctatcagatcaattcaatctttttttggtcattttcttttgttccaattaaatcagattcattgaactccacaatctagtacaatagatg

SEQ ID NO: 6660 - DNA, 682 bp, Artificial
  Synthetic
ctcgagcttgcggccgcctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttgaagagcttttttttgtcattttgttttgtttcaagttcttatatttaagattctggatagtaaggatttcgtgttgtggtaacctttttgcggccgcaagctcgag

SEQ ID NO: 6661 - DNA, 409 bp, Artificial; identical to SEQ ID NO: 4435
  Synthetic

SEQ ID NO: 6662 - DNA, 422 bp, Artificial; identical to SEQ ID NO: 4436
  Synthetic

SEQ ID NO: 6663 - DNA, 324 bp, Artificial
  Synthetic
ttacaaccatggctgacgtcgaggcactcaaggcaaaatacgttctccaaaccgccggctttgatgcccggttccccaacgctaaccagagcaagcactgcttccaaaactacctcgactaccacaagtgcatcaatgccaagggcgaggactttgccccctgcaagcagttctaccgtgcatatcgctcgctttgccccaacgattgggtctctcgctttgacgagcaaagggagaacggtaccttccctgcttccctcgaaccttgaatgtaaacactgtccatttgttacgaaccaaggccaataaaaatgtttctcacac

SEQ ID NO: 6664 - DNA, 594 bp, Artificial
  Synthetic
ccgcttcccaaaccccagccaccgccgccgccgccgccaccaccgttgccgttgccgcctccaccacccgccctcgaccacagccatgccgccgaagctcgacccgacccaggtggtggatgtgttcgtccgcgtgaccggcggtgaggtcggcgcggcgtcgtcgctcgcccccaagatcgggccgctcggtctctccccgaagaagatcggagaggacatcgccaaggagaccgccaaggactggaagggcctccgcgtcaccgtgaagctcaccgtccagaaccggcaggccaaggtctccgtcgtcccctccgccgcggcgctcgtcatcaaggcgctcaaggagcccgagagggaccgcaagaaggtgaagaacatcaagcacagcggcaacatcagcctcgacgacgtcatcgagatcgcgagggtcatgaggcccaggtccatggccaaggagatggccggcaccgtcaaggagatcctcggcacctgcgtcagcgtcggctgcaccgtggacggcaaggaccccaaggacctgcagcaggagatctccgacggcgaggtcgagatcccctcagcttaagcaggttt

SEQ ID NO: 6665 - DNA, 624 bp, Artificial
  Synthetic
ccccgctaccttcccaaaccccagccaccgccgccgccgccgccaccaccgttgccgttgccgcctccaccacccgccctcgaccacagccatgccgccgaagctcgacccgacccaggtggtggatgtgttcgtccgcgtgaccggcggtgaggtcggcgcggcgtcgtcgctcgcccccaagatcgggccgctcggtctctccccgaagaagatcggagaggacatcgccaaggagaccgccaaggactggaagggcctccgcgtcaccgtgaagctcaccgtccagaaccggcaggccaaggtctccgtcgtcccctccgccgcggcgctcgtcatcaaggcgctcaaggagcccgagagggaccgcaagaaggtgaagaacatcaagcacagcggcaacatcagcctcgacgacgtcatcgagatcgcgagggtcatgaggcccaggtccatggccaaggagatggccggcaccgtcaaggagatcctcggcacctgcgtcagcgtcggctgcaccgtggacggcaaggaccccaaggacctgcagcaggagatctccgacggcgaggtcgagatcccctcagcttaagcaggtttggcattggggtggttgttatgtga

SEQ ID NO: 6666 - DNA, 537 bp, Artificial
  Synthetic
agaaaaaatgcctcctaagtttgaccccaatgaggtgaagatcatctacctgcgagccatgggtggtgaggtcggagcttcctccgctcttgctcccaagattggtcctctcggtctgtcccccaagaagattggtgaggatatcgccaaggccaccaaggcccacaagggtgtccgagtcactgtccagctgaccatccagaaccgacaggccaccgtctccgtcgtcccctctgcctcttctctggtcattgctgctctcaaggagcccccgcgtgaccgaaagaaggacaagaacgtcaagcacaacggtaacatccccctggaggagatcattgagattgcccgaaccatgcgatccaagtctttctccaaggagctgtccggaaccgtcaaggagattcttggtactgcccagtctgttggcgcccgtgtcaacggtaagcccgctcacgtcatgattgatgctatcaacaacggcgagcaggacatccccgataactaaagttgtcgtaaaaaataaatttgtttattatg

SEQ ID NO: 6667 - DNA, 545 bp, Artificial
  Synthetic
ggccctcaaggagcccgagcgtgaccgcaagaagaccaagaacatcaagcacaacggtaacatctccctcgatgacgtcatcgatgtcgcgcgtatcatgcgtccccggtccatggctaaacacctcaccggcagcgtcaaggaaatcctcggtacctgtgtttccgtcggttgcaccgtcgatggtaaagaccctaaagacttgcagaccgagatcgatgagggcgaagttgagcttcctgaggattgaacaccaacctctgcctcacccccaacacctccccccgtcgttccccgttttgaggtttttttttaaaaacttttcgcgatgaaattgcattgccggagttggttagttccgtccgtcgccgtagtttcttaggccatttttctttaaccccctagatgagacctgcaaaacagttcttctcgtttagtcggttgcgcgtagctgtgcttgatctcgatttcatgatgaaagctgctataacaatatcgtttctttcatagtctttttccttgaggtctcaaaaaaaacaacaaac

SEQ ID NO: 6668 - DNA, 360 bp, Artificial
  Synthetic
cccacgcgtccggaaactccaaaacacagagccatgccgccgaagttggacccgagccagatcgtcgatgtgtacgtccgtgtaaccggaggagaagtgggagccgccagttctctagctccaaagatcggtcctctcggtctcgcaccaaagaagatcggagaagacatcgcgaaagagacggccaaagaatggaaaggacttcgtgtcaccgtgaagctgacggttcagaatcgtcaagctaaggtaaccgtggttccatctgctgcagctctcgtcatcaaggcgttgaaggagccagagagagaccgtaagaaggtgaagaacattaagcataacggtaacatctctttcgatgat

SEQ ID NO: 6669 - DNA, 548 bp, Artificial
  Synthetic
aaatgccgcccaagttcgatccatctcaggttgtcgaggttttcgtccgagttaccggcggtgaagtcggagctgcgagttcactcgctccaaaaatcggtcctctcggtctctcccctaaaaaaattggtgaagacatcgcaaaggagaccgccaaggactggaagggtctccgagtcaccgtaaaactcaccgtccaaaaccgtcaagctaaagtctccgtcgttccctccgccgccgcactagtcatcaaggcgttgaaggagccggaacgtgaccgtaagaagaccaaaaacatcaaacataacggtaacatctctctcgatgacgtcatcgagatcgctaaggtgatgaagccaagatcgatggcgaaggatttgactggaacagtgaaggagattttgggcacgtgtgtatctgttggttgtacggtagatggaaaggatcctaaggatttgcagcaagaggtagatgatggtgatgtcgagattcctctcgattgaatgctaattatcaacggatggtaatattatgttaattttatgtta

SEQ ID NO: 6670 - DNA, 710 bp, Artificial
  Synthetic
gccctagctacactcttcctctacttttctaagtgtaacaaaaatgccgccaaagttcgatccttctcaggttgtcgaagtcttcgtccgcgtcaccggcggcgaagtcggtgcggctagttcactcgctccaaaaatcggtccactcggtctctcccccaagaaaatcggagaagacatagctaaggaaaccgccaaggattggaagggccttagagttaccgtcaagctcaccgtccaaaaccggcaggccaaagtctccgtcgtaccttccgcagcggcgctcgtaatcaaggctttaaaggagcctgagagagatcgcaaaaagacgaagaacatcaagcacaatgggaatatttcgctggatgatgtgattgagattgcgaaagtgatgaagccgagatctatggcgaaggatttgacaggtactgtgaaggagattttggggacgtgtgtgtccgttggatgtactgttgatggaaaggatcctaaggatttgcaacaggagattgatgatggtgatgttgagattcctctggattgaggaataagaggttaattttaagatgtgtttgttatatttagtattattatgtgatattttgtttatttggatttgaggataattttggagaaattgtcagttttattggcattgttaggatttgattattaccttttttatgttgatgaaatgctctattttgttt

SEQ ID NO: 6671 - DNA, 694 bp, Artificial
  Synthetic
ccctcgaccacgcgtccgctagcccattctcactccctcgcttcctaatgccgcccaagttcgatccatctcaggtggtcgaggttttcgtccgagttaccggcggtgaagtcggagctgcgagttcactcgctccaaaaatcggtccacttggtctctcccctaaaaaaatcggtgaagacatcgcaaaggaaaccgccaaggactggaagggtctccgagtcacagttaaactcaccgtccaaaaccgtcaagctaaagtttccgtcgttccctctgccgctgcactcgtcatcaaggcgttgaaggagccggaacgtgaccgtaagaagaccaaaaacatcaagcataacggtaacatctcgctcgatgacgtcatcgagatcgctaaggtgatgaagccgagatcgatggcgaaggatttgactggaacagtgaaggagattttgggcacgtgtgtatcagttggctgtacggtagatgggaaggatcctaaagacttgcagcaagagattgatgatggtgatgtcgagattcctctcgattgaacgctaattatcaactgatggtaatattatgttaatttttttttgacgttgtcatcttgaggatcattttgatataactatgactagtaaacactggaattttatatttggcaatgtagtttggattttgtttttgctcgatgaag

SEQ ID NO: 6672 - DNA, 690 bp, Artificial
  Synthetic
ttttttgtagaaaattgaacattttgattaatcccaagaaaggattcaaatgggcaaaagccaacaattctcaacttccgaaatatagtattactaataccaaatcctcaaaatcaaatacaaaaaataaaacgatagagaactcaaaagtaaaaacctttatcactcgttaggaatatcaatgtcaccactgttaattttcctgaagatccttagggtctttaccatcaacagtgcaaccaaaagagacacaagttcctaaaatctccttcactgttccactcaattccttagcgatagatctaggacgcattatcttagcaatctcaatcacatcatcaaacgaaatgttgccattatgtttgatgttcttcactttcttcctatctctctctggctccttgagggctttgatgactagagccgctgcggatggaaccactgtgaccttagcttgacgattctgtaccgtaagcttcacggtgactcgaagacctttccattctttcgctgtctctttggcgatgtcttctccgatcttctttggtgccagaccgagtggaccgatctttggagcgagtgaagacgctgctccgacctcacctccggtgactcggacgtagacgtcgacgatttgagatggatccaatttcggcggcattttctctgattcttctccggacgcgtggg

SEQ ID NO: 6673 - DNA, 73 bp, Artificial; identical to SEQ ID NO: 5087
  Synthetic

SEQ ID NO: 6674 - DNA, 699 bp, Artificial
  Synthetic
gatcagctatggagagcgtggcgctcaagcgagtttctgctgtagccaaccatctcaatcccgagcagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgctccagaaacaaggaatacttgtcaatcactgggctggcagactttaacaagcgaagcgcgacgctcattcttgggagcgatagccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgcatgtgctcataatcccactggcgtggatc

SEQ ID NO: 6675 - DNA, 655 bp, Artificial
  Synthetic
  misc_feature (176)..(176): The residue at this position can be any nucleotide.
ccctcgaccacgcgtccgcggacgcgtgggtttcatcgatcagttcttccctttctcttcggttccctgtaaaaccaaagcctccccatttttctcttctacccgagctttaagatggcttccacaatgttctctctagcttctgccgctccgtcagcttctttttccttgctgantatctcaagtcaaagctgaagttggggacttctaaccaaagtgcctttttcgggaacgacttcgtgaaggcaaagtcaaatggtcgtactactatgactgttgctgctaacgtctctcgatttgagggaataactatggctcctcctgaccccattcttggagtttctgaagcattcaaggctgatacaaatgaactgaagcttaaccttggtgttggagcttaccgcacggaggagcttcaaccatatgtcctcaatgttgttaagaaagcagaaaaccttatgctagaaagaggagataacaaagagtatcttccaatagaaggtttggctgcattcaacaaagtcacagcagagttattgtttggagcagataacccagtaattcagcaacaaagggtggctactattcaaggcctgtcaggaactgggtcattgcgtattgctgcagcactgatagagcgttacttccctggctc

SEQ ID NO: 6676 - DNA, 688 bp, Artificial; identical to SEQ ID NO: 5072
  Synthetic

SEQ ID NO: 6677 - DNA, 667 bp, Artificial; identical to SEQ ID NO: 5073
  Synthetic

SEQ ID NO: 6678 - DNA, 711 bp, Artificial
  Synthetic
gacccaagatgcttagaacaatcagatcccaatccatgcgaatggcctccgcctcgtcgcgaagaatgctgtcttccgccgcctccacatccatgctaagacaaacgctcaaggctccctccatgaccgctcaggtcactcgacccaccgtcatgaccttcaagcctgttctgctgtcccgaggatacgccgacgttgttgaggtgcctcccatggccgagtctctgactgagggtactctgaccgcctttgagaaggacattggagactttgtcgaggccgatgaggagatcgccaccatcgagaccgataagattgatgttgccgtcaacgctcccttcgccggaaccatcaccgagttcctggtcaagcccgacgacaccgtcactgtcggccagcctcttctcaagattgagcgaggcgagggctccagcagcggtggctccaagcctcccaaggagaagaaggaggagaagacggaggagaaggaggagcctgctcccaaggaggagtctgcccctgcccctaagaaggaggaggcccccaagaaggaggagtctgcccctgctcccaagaaggaggagaagaagcccgctcccaaggaggagaagaagaccgatgccaccgagggtctcggcggcttccgaaaggaggagcgagtcaagatgaaccgaatgcgacttcgaattgctgagcgactcaaggagtccc

SEQ ID NO: 6679 - DNA, 661 bp, Artificial
  Synthetic
gctcgctaagcacctgcaaaacttaccttgacacttttgtcaatttcattctttaagaacaaccgcatcaataatcttaatcaagctccctcgagtttaattcctaataccgacaaaatgaagttcaccgctgctgtcgctctcgccgccgttggcgtttctgccgtctacgttcctcctagcaacgtcaccgttgttaccgatgtcgttgaccaatacgtcacctactgcccctacgctacccagatcacccacggcagcaagacctacaccgtcactgagcccaccactctgaccatcaccgactgcccctgcaccatcacccgccccgttaccgtcaccagcagcgttgtctgcaacacctgcggtaacgccgcccctactggtgctccctccggtggcaacggcggtggttacactcctcctgccttcaccaactccaccatcaccacccctacccaggcccctccccccagcggccctgccagcactggtggtgttgttcctactgctcctcccgccgtccccactggcggtgccagcaaggccgtcctctccggcgccggccttgccggtatcgtcggtctggccgccttcgtcctgtaaatcttgtaaatttcgacacctcgccaatttaccgggctacgatttcttggttcta

SEQ ID NO: 6680 - DNA, 896 bp, Artificial
  Synthetic
gacccacgcgtccgcaagcatccctatcgtatcaactttcaactccaggttagtactcataccattcgatatcatgttcatgctccggcccacgctacgacttctgttcgcctgcccctccttactgcactcgtcgccttagctaccccgccagaacttccctgcgtcaccaatttttttttctcccttatttacccctcctccctcccacctctacaagcagagattttgaagcttaccacgcataaccatcaatcgcagtcacaaatcagctacaatggctcccatcaaggtcggcatcaacggcttcggtcgaattggacgtatcgtcttccgcaacgctgttgagcaccccgacatcgaggtcgtcgccgtcaacgaccccttcatcgagaccacctatgctgtgagccgcgtcccccctctttttttttctctctgaaaatgcccctcctcagcccaacgcaagcaatgcccaattgagggtagaaaagagacgaataataagagtgcactgcttgaatgaatctcttgatatcatgagattgaagcgcttcgacaatgatgctgtcatcatgggagagaaatcttctcaagcaatggcaggagctgcaatggcattgtcgacagatgagctacacttaatgtctcaaaagtcgtcaatgtcggacaagattccaactccttcgtctcacgccactacccctcactacatgtgcagcttcattgttcatccgctaacccgagacatcgctaggcctacatgctcaagtatgattcctcccacggtattttcaagggcgacatcgatgtcgatggcaaggacctcgttgtgaacggcaagaaggtccgcttctacaccgagcgtgaccctgccaacatcaagtggagcgaga

SEQ ID NO: 6681 - DNA, 641 bp, Artificial
  Synthetic
acatcaacaatggccatcaaagtcggtattaacggattcggacgaatcggacgaattgtcctgcgaaacgctctcaagaaccctgaggtcgaggtcgtcgctgtgaacgaccccttcatcgacaccgagtacgctgcttacatgttcaagtacgactccacccacggccgattcaagggcaaggtcgaggccaaggacggcggtctgatcatcgacggcaagcacatccaggtcttcggtgagcgagacccctccaacatcccctggggtaaggccggtgccgactacgttgtcgagtccaccggtgtcttcaccggcaaggaggctgcctccgcccacctcaagggtggtgccaagaaggtcatcatctccgccccctccggtgacgcccccatgttcgttgtcggtgtcaacctcgacgcctacaagcccgacatgaccgtcatctccaacgcttcttgtaccaccaactgtctggctccccttgccaaggttgtcaacgacaagtacggaatcattgagggtctcatgaccaccgtccactccatcaccgccaaccagaagaccgttgacggtccttcccacaaggactggcgaggtggccgaaccgactctggtaacatcatcccctcttccactgg

SEQ ID NO: 6682 - DNA, 931 bp, Artificial
  Synthetic
tactcatctcagtcgtgtctgtcattattaccgacccacgcgtcggttttctaaaagctcgtcttctcttctcttcttcgatcagcgaaaagctctctctagtttcttcgattcttctacagcgatgggttccgaaggacacaaggtgaagcttggaatcaatggatttggccggatcgggaggcttgtggcccgagtcgcgctggaacgcgacgatattgagctcgtggcggtgaatgatccattcatcagcacagactatatggcatacatgttcaagtatgacagtgtccatgggaaatggaagaaggccgatattgaggtcaaggaccaggaaactctgtcctttggaggcaaggccgtcaaggcctttggctgcaaggatccctccgaaattccctggggaaagtgcggtgttgatttcgtggtggaatccacgggtgttttcaccgagaaggaaaaggcctcggcacatctcaagggtggagcaaagaaggtgattatctcggctcctagcaaggatgctccaatgttcgtcgttggtgtcaacgagaccgagtacaagaaggatatggatattgtttccaacgcaagttgcactacgaattgtcttgctcctcttgccaaggtcattcacgataagtttggcattgtcgagggccttatgaccactgtgcactcccttactgcctcgcagaagactgtcgatgggccgtcttccaaggactggcgcggtggaagaggtgccggctttaacatcatccccagctcaactggagctgcgaaggctgtgggaaaggtgttacccgatctgaatggaaagctcactggaatgtccttcagagttccaactccagatgtctccgtggtggatctcactgtccgcctcgagaagggagcttcttacgacgaaatcaagcaggcaatgaag

SEQ ID NO: 6683 - DNA, 608 bp, Artificial
  Synthetic
ccccgacctctccatatccggcttccagacgcttctctcctgctctaatctcaagtctctgtctcgtcgtcctcgcatctccactcgccatgggcaagattaagatcggaatcaacggtttcggaaggatcgggaggctcgtggccagggtggccctccagagcgaggatgtcgagctcgtcgccgtcaacgaccccttcatcaccaccgactacatgacctacatgttcaagtacgataccgtgcacggccaatggaagcacagcgacatcaagatcaaggactccaagactctgctcttgggcgagaagccggtcaccgttttcggcatcaggaaccctgacgagattccgtgggctgaggctggttctgagtatgtcgtggagtccaccggtgtcttcactgacaaggagaaggctgctgctcacttgaagggtggtgccaagaaggttgtcatctcagccccgagcaaagatgctccgatgtttgtctgcggtgtcaacgaggacaagtacacttcagatattgatattgtctcaaatgctagctgcaccacaaactgccttgctcctcttgccaaggtcattcatgacaactttggtattatc

SEQ ID NO: 6684 - DNA, 50 bp, Artificial
  Synthetic
agcttaccacgcataaccatcaatcgcagtcacaaatcagctacaatggc

SEQ ID NO: 6685 - DNA, 615 bp, Artificial
  Synthetic
aaacacttacttcttaaaattaatttctctcgtttaatttattgttataagcatcatgggcaaagtcaagatcggaatcaatggatttggaagaattggcaggttggttgctagggtggcactacagagtgatgacttagaactagtcgctgtcaatgaccccttcatcaccaccgactacatgacctacatgttcaaatacgacactgttcatggccaatggaagaaacaggagcttaaagttaaggatgaaaagactcttctctttggcgataaggccgttaaagtatttggtgctaggaaccccgaagaaattccatggggtgaggctggagcagagtatgttgtagaatccactggagttttcactgataaagacaaagctgcagctcacttgaagggaggtgcaaagagggttgtcatttcagcccctagcaaggatgcgcccatgtttgttatgggcgtcaatgagaaggaatacaaaggagatgttaacattgtctctaatgctagttgcactaccaactgtcttgctccattggctaaggttattaacgacaaatttggtattgtcgagggacttatgaccacagtccactctattactgcaactca

SEQ ID NO: 6686 - DNA, 825 bp, Artificial
  Synthetic
tcccggtctccctgtaccaactagtactactattaaacccttcccaccaacttcccctccactacaccatttcacaagaacctctcaattagatcggactccattttccctctgaattcacaaagatcatggccaaggttaagattggaatcaatggttttggaagaattgggcgattggttgccagggtggcactccagagagatgacgttgagctcgttgctgttaatgaccccttcatctccgttgaatacatgacatacatgtttaagtatgacagtgtccatggccagtggaagaaccatgagctcaaggttaaggatgataagactcttctctttggtgagaagcctgttgctgtatttggcattagaaacccagaggagattccatgggctgaggctggagcagagtacatcgtggagtcgacaggagtcttcactgataaagacaaggctgctgcccacttgaagggtggtgctaagaaagtcatcatttctgctcctagcaaggatgctcctatgtttgttgttggcgtcaatgagaaggaatacaagccagacctcaacgttgtttctaacgctagctgtaccactaactgcctcgcgcctttggcaaaggttattcatgacagatttggaattgttgagggtcttatgaccactgtccactccatgactgccacccagaaaactgttgatggaccatccgccaaggactggaggggtggaagggcagcatccttcaacattattcctagcagtactggagctgctaaggctgttggaaaggtgctaccatcattgaatggaaagttaactggaa

SEQ ID NO: 6687 - DNA, 375 bp, Artificial
  Synthetic
cccacgcgtccgcactattttcacattcttcttctctctcgatatcatctaaatctctctcttgatctcaatttcgcaaaatggctgacaagaagatcagaatcggaatcaacggtttcggaagaatcggtcgtttggttgctagagttgttcttcagagggatgatgttgagctcgtcgctgttaacgatcctttcatcaccaccgagtacatgacatacatgtttaagtatgacagtgttcacggtcagtggaagcaccatgagcttaaggtgaaggatgacaaaactcttctcttcggtgagaagccagtcactgttttcggcatcaggaaccctgaggacatcccatggggtgaggctggagctgactttg

SEQ ID NO: 6688 - DNA, 345 bp, Artificial
  Synthetic
cggacgcgtgggcgattctacaatggctgacaagaagattaggatcggaatcaacggattcggaagaattggtcgtttggttgctagagttgttctccagagggacgatgttgagctcgtcgctgtcaacgaccccttcatcactactgagtacatgacctacatgttcaagtacgacagtgttcacggtcaatggaaacacaatgaactcaagatcaaggatgagaagacccttctcttcggtgagaagccagtcactgttttcggcatcaggaaccctgaggatatcccatgggccgaggctggagctgactacgttgttgagtctactggtgtcttcactga

SEQ ID NO: 6689 - DNA, 634 bp, Artificial
  Synthetic
cacagctttgcgtttgcgcgtcctctcgatctccattcgtttttgagttcctcgtttgctccgcctctctttcactcatgggcaagattaagatcggaatcaatgggttcggccgcatcggcaggctggtggccagggtggcgctgcagagcgaggatgtcgagctcgttgccgtcaacgatcccttcatcaccaccgagtacatgacatacatgttcaagtatgacaccgtccacggccagtggaagcatcatgaggtcaaggtcaaggactccaagaccctcatctttggcacgaaagaggttgcggtgttcggctgcaggaaccctgaggagatcccatgggctgcggctggtgctgaatacgttgttgagtctactggtgttttcaccgacaaggacaaggcagcagctcacttgaagggtggtgccaagaaggtcgtcatttctgctcccagcaaagacgcccccatgttcgttgttggtgtcaacgagaaggagtacaagtctgacgttaacattgtctccaacgctagttgcaccaccaactgcctggctcctctcgccaaggtcatcaatgacagatttggcatcgttgagggtttgatgaccactgtccatgccatcactgctac

SEQ ID NO: 6690 - DNA, 789 bp, Artificial
  Synthetic
cggacgcgtgggcgcgtcctggggtgattgatgttttttttctgatttttttggtgaattttctggtggtgtttttggggacgcaggcaagattaagatcggaatcaacggtttcggaaggatcgggaggctcgtggccagggtggccctccagagcgaggatgtcgagctcgtcgccgtcaacgaccccttcatcaccaccgactacatgacctacatgttcaagtacgataccgtgcacggccaatggaagcacagcgacatcaagatcaaggactccaagactctgctcttgggcgagaagccggtcaccgttttcggcatcaggaaccctgacgagattccgtgggctgaggctggtgctgagtatgtcgtggagtccaccggtgtcttcactgacaaggagaaggctgctgctcacttgaagggtggtgccaagaaggttgtcatctcagccccgagcaaagatgctccgatgtttgtctgcggtgtcaacgaggacaagtacacttcagatattgatattgtctcaaatgctagctgcaccacaaactgccttgctcctcttgccaaggtcattcatgacaactttggtattatcgagggtctgatgacaactgttcatgccatcactgccacccaaaagaccgttgatggaccgtccagcaaggactggaggggtgggcagggcggccagttttaacatcattcccagcagcactggtgctgccaaagctgttgggaaggttcttcctgatttgaatggcaagcttacgggaatgtccttcc

SEQ ID NO: 6691 - DNA, 214 bp, Artificial
  Synthetic
gatcagtcgacaattcattcaacatggctaatgaaacgcctgtaaatatcggtctggccgttggcctgaacaagggccactagatctctgctcttgtcatcaagccccgtgtatctcgcaactagggccaactgatcaagcgaaccgctttcgtgcgtgacgtcctcaaggacgttgatggcctctccccctacaaccgtcgtgtcatcaaact

SEQ ID NO: 6692 - DNA, 601 bp, Artificial
  Synthetic
atagcacctgtcaacggctgcccagcatgattgctagccgcctgataccccgaagtgccatccgcacgctgcccagcaggcaattgaccctgtcacgatggagtcgaggatttgcctctgcttctgaggagaaggacctgatcatcatcggtggtggtgttgccggatatgtggccgccatcaaggccggacaggagggcatgaaggtggcctgcattgagaagcgtggcaccctcggcggtacctgcttgaacgttggctgcattccctcaaaatcgctgctcaacaactcccacctgtaccaccagattctccatgactcaaaaaaccgcggtatcgaggtcggagaggttaaactcaacctcgagactttcatgaaggccaaggaaaccgccgttaccggcctgaccaagggtgtcgagttcctcctgaagaagaacggcgccgagtacatcaagggcaccggttccttcatcaacgagaacgaaatcaaggtcgaactcaatgacggcggcgagtccgtcatccgcggcaagaacattctcatcgccaccggctctgaagccactcccttccccggcctcaccattgacgagcagcg

SEQ ID NO: 6693 - DNA, 665 bp, Artificial
  Synthetic
gaattcataatcgatcagattcttctaggcagtcttattcggcgatctaacctaaatttcttcgacacctctctgaagatgcagatttttgtgaaaaccctcactggcaagaccatcacacttgaggttgagagctcagacacaattgacaacgtgaaagctaagattcaagataaggaaggaattcccccggatcagcagaggttgatctttgctggcaaacagttggaagatggaagaactctagctgactacaacatccagaaagaatccactctccatctcgtcctccgtctcagaggtggtatgcaaatatttgtgaaaaccctcactggcaagaccattactttggaagtggagagttctgataccatcgacaatgtcaaggccaagatccaagataaggaaggtattcctccagaccagcagaggttgatttttgctgggaagcagttggaagatgggcgtacccttgctgactacaacatccagaaggaatccacccttcacctggttctacgactaagaggtggtattgcagatctttgtgaaaacgcttactggaaagaccatcaccttagaagttgagagttcagataccattgacaatgtaaaagccaaaattcaggacaaggaaggtattcctccagaccagcaacgtttga

SEQ ID NO: 6694 - DNA, 616 bp, Artificial
  Synthetic
  misc_feature (434)..(434): The residue at this position can be any nucleotide.
acgcgtcgagagtagagagagagagagagagagagagagagaagatgcagatattcgtgaagaccctgacggggaagaccatcaccctagaggtcgagagcagtgacaccatcgataatgtcaaagcaaagatccaagacaaggaaggaattccaccggatcagcagaggcttatttttgctgggaaacaactggaggatggtcgcacattggctgactacaatatccagaaagagtctactttgcaccttgttttgaggcttcgaggtggtatcatagagccttcgctgatggcgctcgccaggaagtataatcaagagaagatgatatgtcgcaagtgctatgctcgtcttcatcctcgcgctgtgaactgcagaaaaaagaaatgtgggcacagcaatcagcttcgaccaaagaagaagatcaagtaggtngttcggttgcagcctctccagatattcagaatcttgtttttttgctgatttgaggaaaagttgtttgagtgccatttaccatgttttggtgcaagtggcactcttattatgttaatctctgcgaagtaattactgacgatgagtcgtttgcatttgaattttcggaacaaaaggaatttgaa

SEQ ID NO: 6695 - DNA, 670 bp, Artificial
  Synthetic
gtagggtttcaagtgggctgccaagatgcagatcttcgtgaagacgctcacgggcaagacgatcactctcgaggtcgagagcagcgacaccatcgacaatgtcaagaccaagatccaggacaaagaaggcattcctccggatcagcagcgtctcatcttcgctggcaagcaactcgaagatggccgaactctcgcggactataacatccagaaagagtccactctccatctcgtgctgcgtcttcgtggaggcatcatcgagccgtccctgatggccctggcgaggaagtataatcaggagaagacgatctgccggaagtgctatgcaaggctgcatcctcgcgctgtgaattgcaggaagaaaaaatgtggccactccaaccagctgcgacccaagaagaaaatcaaatagagagtttaggacgatcaactttgtttttcttcattctctatatgaatgaaaaagggaaaacctttgtctttaaaaacccttgtaaaacccgacctttagggcggggcggtagcgatgggcgagacgacgacgacgcatcctccaacaatgctcttcgtggagcatcgcgccgtgcaggaagccgcgaggacgagtagtagattcatcgtctccgcatcgacgtgcgtcaaggtcgggctggcgagcttcgcgatcggc

SEQ ID NO: 6696 - DNA, 628 bp, Artificial
  Synthetic
gcggacgcgtgggcggacgcgtgggcggacgcgtgggcgaggcgaggagagcggcggcgaagaaggacaagtctggagccatgcagatcttcgtcaagacattgactgggaagacaatcaccctcgaggttgagtcgtcggacacgatcgacaatgtgaagaccaagatccaggacaaggaagggatccctcccgaccagcagcggctgatcttcgcgggcaagcagctggaagatggccggacgctggcggactacaacatccagaaggagtcgaccctccaccttgttcttcgcctccggggtggcggcaagaaaaggaagaagaagacgtacaccaagcccaagaagatcaagcacaagaagaagaaggtgaagctggcggtgctccagtactacaaggtggacgattcgggcaaggtgaacaggctgcgcaaagagtgcccgaatccagagtgcggtgccgggacgttcatggcgaaccactttgatcggcactactgcggcaagtgtggactcacctacgtctaccagagagctgaagcttagagaggatgacgagctttgctctctttccttgtgtttctatccaattttctttgaacgaaagtataatcttttcttttgtt

SEQ ID NO: 6697 - DNA, 533 bp, Artificial
  Synthetic
gaaagacgcacagttttctttgcagacgacaccgaaatgcagatttttgtcaagacccttaccggtaagactatcaccctcgaggtggagtcttccgacaccatcgacaacgtcaagtccaagatccaggacaaggagggaattcccccggaccagcagcgacttatcttcgccggtaagcagctcgaggacggccgaaccctttctgactacaacatccagaaggagtccactctccatctcgtcctgcgacttcgaggtggtggtaagaagcgaaagaagaaggtctacaccacccccaagaagatcaagcacaagcgaaagaagaacaagcttgctgtcctcaacctctacaaggttgacgatgacggaaaggttgagcgacttcgacgagagtgtgagtctgagtcctgcggtgccggtgtcttcatggctgacatgaaggaccgacagtactgcggccgatgccacctcaccctcaaggcctaaatgtattgatttagtttagtatatttatctcttgaacaaaaaaa

SEQ ID NO: 6698 - DNA, 914 bp, Artificial
  Synthetic
tccgcaacatctgaagattgcttaggacggcaataggtctattgtcgaggtatgtctgaaagatgctgcatttctatctgccctccatgagctccgggagcttcatgagggaatcatcgttgatgtctccctcttgagcattcttctttgtttcccggagctctattccccaaatcccgagatattgctcgttgtcgcgaagaaatttgcaacacggcaattctcgccttcttctccccaaagtcaactcacgcaggcaatgtatgctgggcaaacaaatctaacccttccagttaggcaagatgcagattttcgtcaagaccctcacggggaagacgatcacccttgaggtggagtcttccgacaccatcgacaatgtcaagtccaagatccaggacaaggagggcattcccccggaccagcagcgattgatcttcgctggtaagcagctggaggatggccgaaccctctccgactacaacatccagaaggagtctaccctccacctggtcctgcgcctgcgtggtggtgccaagaagagaaagaagaaggtctacaccacccccaagaagattaagcacaagcgcaagaagaccaagttggctgtcctcaagtactacaaggtcagcaacgatggtaacatcgagcgtctccgccgcgagtgccccagcgagacttgcggtgctggtgtcttcatggctgccatgcctgaccgtcaatactgtggtcgttgccacctgacctacgtcttcgacaagcagtaaacgacaaaactttcaaaaagggaaaaaatttattgtggattggacagctggagccatgggactgccataacacacaaaggcgttgatgtagcattagagagcacatccggcggcttctggtaatgaatgcttgatttgagacacgtttgg

SEQ ID NO: 6699 - DNA, 1113 bp, Artificial
  Synthetic
atacaaacacttctcacatctcttccaccctaaggaatatccgttaacagcgcatcttcttgcactctctacgaatctcccagcggccaacgcttaatccgccaccatgcaaatcttcgtcaagaccctcaccggcaagaccatcaccctcgaggtcgagtcttccgataccatcgacaatgtgaagtccaagatccaggataaggaaggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatccaggacaaggagggtatccctcctgaccagcagcgactgatcttcgctggtaagcagcttgaggatggccgaaccctctccgactacaacatccagaaggagtccactctccaccttgtccttcgtctccgtggtggtatgcagatcttcgtcaagacgttgaccggcaagaccatcacattggaggttgaatcatcagacaccatcgacaatgtcaaatcaaagattcaggacaaggagggtattcccccggatcagcagcgtcttatctttgctggcaagcagcttgaggacggtcgcaccttgagcgactacaacattcagaaggagagcacacttcaccttgtcctccgtcttcgtggtggtatgcagattttcgtcaagactctgaccggcaagacaatcaccctcgaggtggaatcttccgacaccatcgacaacgttaagtccaagattcaggacaaggagggcattcctcctgaccagcagcgcttgatctttgctggtaagcagctggaagacggtcgcaccttgagcgactacaacatccagaaggagagcacactgcacttggtcctgcgtctgcgtggtggccagtaaatgtgtcttttgcttacgaccgcactgttacgactgaattggacggttgggcgtttttgggaactttttttcaaagcagatatgggaac

SEQ ID NO: 6700 - DNA, 1604 bp, Artificial
  Synthetic
acgaaaatctcaacttttctctttacttcaaacgcctctcaagatgcagatcttcgtcaaaacccttaccggaaagacgataacccttgaggttgaaagctccgacacaattgacaacgttaaggctaagattcaggacaaagaaggaatcccaccggaccagcaaaggttgatcttcgccggaaagcagctcgaagacggcagaaccctagctgattacaacatccaaaaggaatccacccttcacttggtgctccgtcttcgtggcggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgatttttgctggtaagcagctggaggatggccgaaccctcgctgattacaacattcagaaggagtctacccttcacttggttctccgtctccgcggtgggatgcagatcttcgtcaaaacactcactgggaagacaatcaccctcgaagttgaaagctccgatactatcgacaatgttaaggctaagattcaggacaaggaaggtattccaccggaccagcagagattgatttttgctggtaagcagttggaagatgggagaactttagctgattataatatccagaaggaatccacactgcatttggtgctccgtcttcgtggtgggatgcagatttttgtgaagacgttgaccgggaaaaccatcactttggaggtagagagttctgatacgatcgacaatgtgaaggctaagattcaggacaaggagggtatcccgccagatcagcagaggctgatttttgctgggaagcagttggaagatggaaggactctggctgattataatattcagaaggagtcgactctgcaccttgtcctccgtctccgtggtggtttctaaagtgtccgtcaatagtggtggtaatgtctgtgtcttgggtcttgggtctgttcggtgtttgtttgattcatgatttagtagtttgtgtagtttttgttagttgtcatcatgttatgccttcaaaagaaggaaggagacttgtcctctttgtctctgtttgcgaataataaagttcgaattatggttt

SEQ ID NO: 6701 - DNA, 764 bp, Artificial
  Synthetic
aggcattgagctacacactatcatagtatcattccattctgaagaaagaagaaattctagcgccgtagtgctcctcgagttctctcctccaaagcgaagatgcagatcttcgtgaaaaccctaacaggtaaaacaatcacccttgaggttgaatcttccgacacaatcgacaatgtgaaagccaagatccaagataaggaagggattcccccagatcagcagcgtctgattttcgccggaaagcagcttgaagacggccgaaccctagctgattacaacatccagaaggagtcgactcttcatctcgtgctccgcctccgtggtggtgctaagaagaggaagaagaagacttacaccaagcctaagaagattaagcacaagaagaagaaggttaagctcgctgtacttcagttctataaggtggatgattctggaaaagtccagaggcttcgtaaggagtgtcctaatgctgagtgtggtgctggaacttttatggctaaccactttgaccgtcattactgtggtaagtgtgggctcacctatgtttacaacaaggccggcgccgattgaggcttatgcttagctctgttttaatgctgtcgtcaattttatccttttgtcgaacggtaatttagtatggattttcctttttaaatggtgtggtaactatgggaattttgagttatttttaaagtttttgcttattattcttaaagttttaggttattatctcaaattttatatccttaattatctactttata

SEQ ID NO: 6702 - DNA, 673 bp, Artificial
  Synthetic
ggaagggaggaagggtggtgtgggtggatttggaggggccaagatgcagatctttgtgaagaccctgacagggaagaccatcaccctagaggttgagagtagtgacaccatcgataatgtcaaggctaagatccaagataaggaaggtatcccccctgatcaacaacgcctgatctttgctggaaaacagcttgaagatggcagaaccttggctgactacaacattcagaaagagtccacgttgcatttggttctaaggttgcgaggtggtatcattgagccatctctgatggctcttgccaggaagtacaaccaggagaaaatgatctgtcgcaaatgctatgctaggcttcatcctcgggctgtgaattgccgcaagaagaaatgtggacacagcaatcagttgcggccaaagaagaagattaagtagatttggagaagcaatcattgcattggaacagtagatgcaggaagagggaaatgggaggaatggagatgcagctttgttattgttttactaggatctgttatacaactgaagtggctcaatgggaactagcttttaggccttagcctttggaccttccataacatttcatcatgcgtgtatcaagagctatgagctgatttgaaattgatcaaagctccccttctgaatgttgcttgcctgaag

SEQ ID NO: 6703 - DNA, 1523 bp, Artificial
  Synthetic
tcatcgccttcaaatttctctctcaaggtttgagaaaatttcctcaatttctcgctttaggagttcttttttattgaatcaccgatttgggtgtgtcaagccctaattttgaagttcattttttcaattgtttgttgttgattttatgttataacagatgcagatcttcgtaaaaaccctaaccggtaagaccatcactctcgaggttgagagttccgacacaatcgacaacgtaaaagccaaaatccaggataaggaaggaattcccccagatcagcaaaggcttatcttcgccggcaagcagcttgaggacggccgtactctcgccgattacaacatccagaaggaatctactcttcacttggtcctccgtctgcgtggtgggatgcagattttcgtcaaaaccctcactggcaaaacaatcacccttgaggtggaaagttctgacaccatcgacaatgtcaaggctaaaattcaggataaggagggaattccaccagaccagcagaggttgatcttcgctggcaagcagcttgaggatggtcgtacccttgccgattacaacatccagaaggagtctacccttcaccttgtcctccgtctccgtggtggtatgcagatctttgtcaaaacgctcaccggcaaaaccatcacccttgaggtcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtctccgtggtggtttctaggttgcctgttgttgatgttgttgtgtcgtgttgattggctgtgtcttgttgtggtcatgatgtgttttgtctactaaggtcccaaagatgttcaattctgtttctgttcgccgtttctttcatattttctgttgtgaataaagacaccagattctgtcctagtgcttaggttttgtgctctctgttggcagtaaatgaactttcctttgttttatccatt

SEQ ID NO: 6704 - DNA, 557 bp, Artificial
  Synthetic
cccacgcgtccgcggagagataagatgcagatcttcgtgaaaaccctaacggggaagaccatcacccttgaagtcgaatcgagcgataccatcgacaatgtcaaggccaagattcaggacaaggaaggtattccaccggaccagcagcgattgatctttgctggtaaacagcttgaagatgggcgtacactggctgattacagtatccagaaagagtcgactctgcatcttgtgttgaggctccgtggagggatcattgaaccgtctcttatggcattggccaggaaatacaaccaggataagatgatttgccgcaagtgctatgcccgtctgcatcctcgtgccgtaaactgcaggaagaagaaatgtggccatagcaaccagttgaggccaaagaagaagatcaagtaaacaggcggttgcatttgctgtctagatgctatgccaattgaatgattttgtagtttggtgggtttctattgttgtctgtttaactgcagcacatttgtttcaacttcagttccatttagtgctcatttttgagtttggtatgatta

SEQ ID NO: 6705 - DNA, 396 bp, Artificial
  Synthetic
gcggctgacaaaccctaatcccatttcgccatcgaacagcgaagatgcagatcttcgtgaaaaccctgacgggtaagaccatcacccttgaggtcgaatcctccgacacaatcgacaacgtgaaggcaaagatccaggataaggaaggcattccaccggaccagcagcggctcattttcgccggaaaacagcttgaggatggacgaaccctagctgattacaacatccagaaggaatccactctccatttggtgctccgtctccgtggtggtgctaagaagaggaagaagaagacttacaccaagcctaaaaagattaagcacaagaagaagaaggttaagcttgctgtgttacagttttacaaggtggatgattctggaaaagtccagaggcttc

SEQ ID NO: 6706 - DNA, 1002 bp, Artificial
  Synthetic
aatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggc

SEQ ID NO: 6707 - DNA, 648 bp, Artificial
  Synthetic
gggcaggtagaggtggaggcaagcgggggaagatgcagatatttgtgaagaccctgacggggaagaccatcaccctcgaggtcgagagcagtgacaccatcgataatgtcaaagcaaagatccaagacaaggaaggaattccaccggatcagcagaggcttatttttgctgggaaacaactggaggatggtcgcacattggctgactacaatatccagaaagagtctactttgcaccttgttttgaggcttcgaggtggtatcatagagccttcgctgatggcgctcgccaggaagtataatcaagagaagatgatatgtcgcaagtgctatgctcgtcttcatcctcgcgctgtgaactgcagaaaaaagaaatgtgggcacagcaatcagcttcgaccaaagaagaagatcaagtaggttgttcggttgcagcctctccagatattcagaatcttgtttttttgctgatttgaggaaaagttgtttgagtgccatttaccatgttttggtgcaagtggcactcttattatgttaatctctgcgaagtaattactgacgatgagtcgtttgcatttgaattttcggaacaaaaggaatttgaattgcattttagctttcagaatcacaatatccaaacattctcttg

SEQ ID NO: 6708 - DNA, 551 bp, Artificial
  Synthetic
cccacgcgtccggaagacgaaacacaaaagatgcagatcttcgtgaaaaccttgaccggcaagaccatcactctcgaggtcgagagcagcgacaccatcgacaatgtcaaggccaagatccaagacaaagaaggaatccctccggatcagcagagattgatcttcgccggaaagcagctcgaagatggtcgtactttggctgactacaacatccagaaagaatctacacttcatcttgtgttgaggcttagaggaggtattattgagccttccttgatgatgcttgctcgtaagtacaatcaggataagatgatatgccgcaagtgctatgctcgtcttcacccaagagctgtcaactgcaggaagaagaagtgtggtcacagcaaccagttgaggcctaagaagaagatcaagtagagagactcttatcaagaatcccatctcttgcttgcttctttttgttgtcttccctttgatagggtttgtttttcttgtttcagtgactttctatgttaaacgataatgtcagtaaaaggatttggttttctatt

SEQ ID NO: 6709 - DNA, 339 bp, Artificial
  Synthetic
cgaacgcaaagatgcagattttcgtgaaaacgctaaccggcaagaccatcaccctcgaggtcgagagcagtgacaccatcgacaatgtcaaggccaagatccaggacaaagaaggaattcctccggaccagcagaggttgatcttcgccggaaaacagcttgaagatggtcgtaccttggctgactacaacatccagaaagagtcgactttgcatcttgttctgaggcttaggggaggtatcattgagccttcattgatgatgttggctcgtaagtataaccaagacaaaatgatttgtcgcaagtgttatgctcgtctccacccaagagctgtgaact

SEQ ID NO: 6710 - DNA, 551 bp, Artificial; identical to SEQ ID NO: 4440
  Synthetic

SEQ ID NO: 6711 - DNA, 526 bp, Artificial
  Synthetic
ataaatggtaaaccacatttagtaaagatgaaaccagtaacagcagatccgatatttgaaaaagaacaggttggtcctagataaagttcaacaccctggtatcatgctagatttagggaaacgactgaaaaaaggtttatcactccggagacaatcaggtgcgagcaacgttgggggcaggagcagcagctccaccaggagcgggagcgccaccacctggacgagggccttggggcctatcctccctgcggcggaagcgttccggaggcctgcggtccctccggttctcacgggagcggacacggacgatgtgagcatggattgcacaggacacacagtgatgcaccttggcgtaaagcttggggagaacgtatccatcgtgcacgcacgcctcctggacgtccctgatggcggcctgctccacgatgttcctcacctgaaacctcttgatcgccttgtccttggggcagcacttggcgcagttggagcagcggatgtacttgacgtggccgcggccgtgcttgtt

SEQ ID NO: 6712 - DNA, 549 bp, Artificial
  Synthetic
ggaagaggtagaggactctttgtaggttttgcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgcgctatccactcccgtgtagtacgtgtccgctccagagaggctcggaggaacagggagccaccacagcgtttccgtagaagggaggataatgccccaggacagaaccgtccccctccccctccccgcccttgagatttgtcaggcagttcattaatcctcgagacttagtgctttttaatatcttagttgcagcctatatgaagctcccactggggcccttatttttgtcttaaaaccaatttgtgctccaaac

SEQ ID NO: 6713 - DNA, 401 bp, Artificial
  Synthetic
gcaaagatggtcaagaagcgagcttccaacggacgaaacaagaagggtcgaggacacgttacctccatccgatgctctaactgtgcccgaatggtccccaaggacaaggccatcaagcgattcaccatccgaaacatggtcgaggccgcctccatccgagatctttccgaggcctccgtctaccaggagtacgtgctgcccaagctctacctcaagatccagtactgcgtgtcttgcgccatccactccaaggttgtccgagtccgatctcgagagggccgaaaggttcgaactcctccccagcgagtccgattcaacaaggacggtaagaagatcaaccctgctgccgccgccaaggttgtcgtttaggcgatgtataaaaaattgcactgtgtatgaag

SEQ ID NO: 6714 - DNA, 594 bp, Artificial
  Synthetic
agagccgcagattatactcagaagctaccatccagagcgaaaatgactttcaagagaagaaacggaggtcgtaacaaacatggacgtggccacacaaaatttattcgttgctctaattgcggcaaatgctgcccaaaggacaaggccatcaagaggtttcttgtaaggaacattgttgagcaagctgctgtacgtgatgttcaggaagcttgtgcttttgaaacgtacactcttcctaagctgtacttgaagatgcaatattgtgtttcatgtgcaattcactctaaggtggtcagagttcgttctgttactgataggagagttcgtgagcccccacagcgtttcaggcgcccaagggatgatctcccaaagccaggtcaagctccacgccccgctggaggagcccctgctgcacctcgcacttaacttgataggcttcaggttttaattaatctgatagttattttatctgttatatgtcgtggttttgactgtactgtttgatttagttgatgggaccatttaccattttatggaattgaattttgaatggaaaatgagagatctaaattttcataatgaagcgcttttaag

SEQ ID NO: 6715 - DNA, 613 bp, Artificial
  Synthetic
tctttgtggttcattcactaggaagaggtagaggactctttgtaggtttttcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgtgctatccactcccgtgtagtacgtgtccgctccagagaggctcggaggaacagggagccaccacagcgtttccgtagaagggaggataatgcccctggacagaaccgtccccctccccctccccgcccttgagatttgtcaggcagttcattaatcctcgagacttagtgctttttaatatcttagttgcagcctatatgaagctcccactggggcccttatttttgtcttaaaaccaatttgtgctccaaacttgtctgttttcagttataaatgaagttttttattatggatact

SEQ ID NO: 6716 - DNA, 499 bp, Artificial
  Synthetic
cggacgcgtgggcggacgcgtgggcggacgcgtgggcggacgcgtgggcggacgcgtggggtcgagttccagccatctccgaaaatgactttcaagagaaggaacggaggtcgcaacaagcatggacgtggccacgtcaaattcgtccgttgctccaactgcggcaaatgctgccctaaggacaaagccatcaagaggtttcttgtgagaaatattgttgagcaagcagctgttagggatgtgcaggaagcttgtgcttttgaaacgtacactctgcctaagctgtatctgaagatgcaatattgtgtatcatgtgccatccactcaaaggtggttagggtccgctctcgaactgataggagggtccgtgagcctccacagcgattcaggcgcccaagggatgatgctccaaagcctggtcaagctccacgggttcctggagctgctccgacagcagcagctcgtacttgagtgcctgctgttttgatcatgttgttta

SEQ ID NO: 6717 - DNA, 599 bp, Artificial
  Synthetic
atccacagctatgactgtgaagcggcggagccgtgggcgtagcaagcatgggcgtggccatgtcaatcccatccgatgctccaattgcggtcgctgctgccctaaggacaaggcagtgaagaggtttcttgttcgcaacattgttgagcaagctgcaattcgggatgtccaggaagcatgcgtttacgatggctatgttcttcccaagctatatactaagatacagcactgcatctcatgtgcaatccactcgcgcgtggtgcgtgttcgctcccgagaggctcggaggaacagggagccaccccaacgattccgccgaagggaggacactgctggaccaaaccgcccgcctgcacctccacgcccttgagcatagggcttacaattgaacatccttttaatctttagactcccaatatgcttattatagagtttctattttgtgattcacaaaggttgcgtgtcttttgaaaggctttgcaactaggaattttctttggtttagcaatgaggcaaagctcactctagttcaattttaagctatttcatgattactgctattttgttgccatgatgaatataaatattttcacttctct

SEQ ID NO: 6718 - DNA, 633 bp, Artificial
  Synthetic
cccacgcgtccgcgccattagagttccatcgtattcactgctcagcagctgctacaactcgtccggccaaaatgacattcaagagaagaaacggaggtcgtaacaagcatggacgtggccacactaaattcattcgctgctctaactgcggcaagtgctgccctaaggacaaagcaatcaagaggttccttgtgaggaacatcgttgagcaagcagcagtgagggatgttcaggaagcttgtgcttttgaattgtacactcttcctaagctgtacttgaagatgcaatattgtgtctcatgtgccatccactccaaagttgttagggtccgctctgttactgataggagggtccgtgagcctccacagcgcttcagacgcccaagggatgatgctcccaagcctggtcaagctccacgccctgccggagctcctactgcagctcgttcttaagtgcctacattttgatcaactactgttaggcttttgggttttagttaatttgagatgtatttttgaagtcgatttctctatttagttttactggaactatcattaaatttgtgtatgcaaatctcaagcaaacaggcctgttgttcgtcctatagcttatatatcctttgcaattaaactc

SEQ ID NO: 6719 - DNA, 401 bp, Artificial
  Synthetic
ctcgagcttgcggccgctaagcttttgatccagaaccaggatgagatgattaaagctggcaggctttctgaaccctacaagggtattggtgactgtttcggcaggacgattaaggatgaaggttttggttctctatggagaggaaacactgccaatgttatccgttatttccccactcaggccttgaactttgccttcaaagattacttcaaaagacttttcaactttaagaaggacagagatggttactggaagtggtttgctggtaacttggcatctggaggagcagctggtgcctcttcccttctgtttgtgtactcccttgactatgcccgtacccgtctagctaatgatgccaaggctgcaaagaaaggaggtggtggaagacagtttgatggtct

SEQ ID NO: 6720 - DNA, 1313 bp, Artificial
  Synthetic
cccccccctctagctcctcgttcttcgcccagctccatttcctctttcgacttccaaggcgagttgaacgcaggagtttacttagcaatggcggataaccagcacccaactgtttttcagaaggtagctaaccagatgcatctgagctccagtctttcccaggatgtccatgctcactacgggggcattcaaaggcctgctttccatcagaggcgttttgcatatggcaattactctaatgcaggactgcaaaactgccaagccacacaggatctctcattgatttctgcaaacgcttcaccagtgtttgtgcaagctccccaagaaaaaggattagcagcttttgccactgacttccttatgggtggtgtttctgctgctgtgtcaaagactgctgctgctcctattgagcgtgtgaagcttttgatccaaaaccaagatgagatgattaaggctggtagactgtcagaaccatacaagggaattggagattgtttcgggaggacaattaaagatgagggatttggttctttgtggagaggaaacactgctaatgtcattcgttacttccctactcaggccttgaactttgcatttaaggactacttcaagaggctcttcaacttcaagaaggaccgtgatggctactggaagtggtttgcaggcaaccttgcatctggtggtgctgctggtgcttcttctttgctctttgtttactcccttgactatgctcgtactcgtcttgcaaatgatgccaaggctgcaaagaaaggaggtgggagacagttcaacggtttggtcgatgtctacaagaagactcttgcatctgatggaattgctggattgtaccgtgggttcaacatttcatgtgttggtatcattgtgtaccgtggtttgtacttcggaatgtacgactccttgaagcctgtgctcttgactggaaacatgcaggatagtttctttgctagctttgctcttgggtggcttatcaccaatggtgctggtcttgcatcctacccaattgacaccgttagaagaagaatgatgatgacatctggtgaggctgtgaagtacaagagctcattcgatgccttctcccagatccttaagaatgagggtgccaaatctctgttcaaaggtgctggtgctaacatcctccgtgccgttgctggtgctggtgtgttggcaggttatgacaagcttcaggtcatagttttcggaaagaaatatggttctggtggtgcctaagtcagacataaactacttgtttttttagaattagaatatggtgatgaaaatccttcaaattccaa

SEQ ID NO: 6721 - DNA, 608 bp, Artificial
  Synthetic
ccccgaggcaaggcacgcgagccctaggcgccagccgactcgaccagcgcccggaggcggagcacccgccgccgccgccctcgccatcgtcggcttcacccctcatcggcaacctagtgcaggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgaggggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctaccc

SEQ ID NO: 6722 - DNA, 660 bp, Artificial
  Synthetic
atttctcatctcgcagggcagggattgcagatctcgaactcccgcacccccctccctgtaatgcgagcacagtcttgctgaagcagttgaaatggctgagagaccgcaagctccgtctgctatgaataggttctctggctacacctacctaggttccaagcttactgagaaccgccaaagaagccgagggccaaacaccaccagcagctactattcgtatgcaataagccgcaatggccagcccaagcagaccccgatgcttaacctgaatggtgctgttggttcagtgaacctggacagtttccagaatgcttcccccgccaatgccgagttttttgcccctgcagcaaaggagaagggagtacaaggcttcttgattgatttcatgatgggtggtgtttctgctgcagtttccaaaactgctgctgcccctattgagcgagtgaagctccttattcagaaccaggatgaaatgctcaagtctggccgtctctctgaaccctacaagggtatcggggaatgtttctcccgaaccattaaggaggaaggcttcatctccctttaccgaggaaatgtggccaacgtcatccgttacttccctactcaggctttgaactttgcattcaaagactacttcaagaggatgttcaacttcaagaa

SEQ ID NO: 6723 - DNA, 1184 bp, Artificial
  Synthetic
attgtctctctcatcaccatctactcctcgttctcctctcctctctatcactactctcgaggcgagtcgaacgcaggacttcgttcaacattgcaatggcagatatgaaccagcacccaactgtcttccagaaggcagctaaccagctacacttgagctcgagtctttcccaagatgtccatgctcgccatgtgggcgtgcaacctgctgtttaccagaggcgttttgcttatggcaaatactccaatgctggactacaaacttgtcaagccactcaggatctatcattgatcacctcaaatgcttcaccagtgtttgtgcaggctcctcaagagaaaggacttgcagcttttgccactgacttcctcatgggtggagtttctgctgctgtgtcaaagactgctgctgcccctattgaacgtgttaaacttttgatccaaaatcaagatgagatgctcaaggctggtaggctctcagaaccatacaagggaattggtgattgttttgggaggacaattaaggaagaagggatcgggtctttatggagaggaaacacagctaatgttatccgttatttccccactcaggctttgaattttgcatttaaggactacttcaagagactcttcaacttcaagaaggaccgtgatggctactggaagtggtttgccggcaaccttgcatctggtggtgctgctggtgcttcctcattgctctttgtctactccttggactatgctcgtacccgtcttgccaatgatgcgaaggcctcaaagaagggaggtgagaggcagttcaacggtttagttgatgtctacaggaagacactcaaatctgatggaattgctggtctgtatcgtggattcaacatttcatgtgttggtatcattgtttaccgtggtttgtacttcggaatgtatgactctttgaagcctgttctcttgactggaaacctgcaggatagtttctttgctagttttggtcttggttggctcatcaccaatggtgctggtcttgcttcctacccaattgatacagtcagaagaagaatgatgatgacgtccggtgaggctgttaagtacaagagttcgttcgatgcattctcccagattgttaagaacgagggtcccaaatccctcttcaagggtgctggtgcaaacatcctccgtgctgttgctggtgct

SEQ ID NO: 6724 - DNA, 705 bp, Artificial
  Synthetic
cgattttctcttggaaaaagatagaaaaacaaaaactcatacattcttcaaagagtgaagcaatgacaattgatcagccacaatacccctctgttgctcataaggtatctggcaacttcctggttagatctacccaaaatcgagatcttctggcataccaaaggcaatataaatatggaaatcagacgaaacctttgttgcatcaatgtgaaggaaaatatgacatgtccgtgatttcgtcctactcatcgccagtttttgttcaagctccttcagagaaaggtttttccagctttgcagttgattttcttatgggtggtgtctcagcagcagtgtcaaagacagcagctgctccaattgaacgcgtcaaactcctgatccaaaaccaggacgaaatgatcaaggctggccggttatcaaaaccatacagtggcataactgaatgttttagccgaacaatgaaagaagaagggattatgtcattgtggagaggcaatacagccaacgttattcgttatttcccaactcaggccttgaattttgcatttaaagattatttcaagaggctttttaacttcaaaaaggaaagagacggttactggaaatggttcgctggcaaccttgcatcaggaggtgcagctggtgcatcttcccttttctttgtgtattctcttgactatgcccgaacaggctagcaaatgatgc

SEQ ID NO: 6725 - DNA, 902 bp, Artificial
  Synthetic
gaattcaggaaacactgccaatgtcatccgttacttccctacccaggccttgaactttgcatttaaggattacttcaagaggctcttcagtttcaagaaggacagagatggctactggaaatggtttgctggtaacttggcatctggaggtgctgctggtgcttcttcacttctctttgtgtactctctctcacttttcttcttcttcttcttcttcttcttcttcttctctcaaacccttggaggagcgagaggaagagaaacatagcagacgactattcatatctctctatagctgagtgtttttagcttttggaagacatgatgggggagaggcctcaacatccaactgttgcccagaaagtagctggtcagtttcgtcttagttccagcctttcccaaggtgctggttcactaaatggagctttcaacactccatctatgtaccagaggcgatatgcctatggaaacagcaatagggcattccagacatgccaagttagtcaagatctatctttgattaaccacagtgcatcacctgtctttgtgcaagcacctgctgagaaaggattggccagctttgctgttgattttcttatgggaggtgtctcagctgctgtctctaaaactgccgctgctccaattgagcgtgtgaagcttttgatccagaaccaggatgagatgatcaaggctggcaggctctctgaaccctacaagggaattggagagtgttttggccgtacaatcaaggaggaagggtttggatcattgtggagaggaaacactgccaatgtcatccgttacttccctacccaggccttgaactttgcatttaaggattacttcaagaggctcttcagtttcaagaaggacagagatggctactggaaatggtttgctgg

SEQ ID NO: 6726 - DNA, 661 bp, Artificial
  Synthetic
  misc_feature (570)..(570): The residue at this position can be any nucleotide.
tcaacctttgcgactctcatcttttcccttccttcagagttaaaatggcagaggggccccgagttccggacgtgaagcacaagctttctggctacacctatttaggctctcagctaacagggaactgtggatattatccccgcacccatggagccgctagctacagcagcagcagcctttctcgggtacagaattggaacatgggttcgtctgtgggccatcccgtctttgtgccttcgaccaaggagaaggggtttcaggggttcatgattgacttcctgatggggggtgtgtcggcagctgtgtcaaaaactgcggcggcccccatagagcgagtaaagctcctcatccagaaccaggacgagatgcttaaatctggtcggctctcggagccgtacaagggtatcggcgagtgcttctctcgtactatcaaggacgaaggctttgtctcgctgtatcgtggtaacactgccaacgtcatccgttactttcctacccaggccctgaactttgcgttcaaagactacttcaagaggatgttcaacttcaagaaagacaaggatgggtatnggacatggttcgctggtaatttggcttccggaggtgcagcgggagcttcgtcgctcttgtttgtttactcccttgactacgcccgaacgcg

SEQ ID NO: 6727 - DNA, 636 bp, Artificial
  Synthetic
aactcttctacaactctaatacttgataacacatccacatccatcatcatgcctccccagcaacatcccttctgggacttcgtgcagtccctcaacaaccccgacccaaacaaccgccgcgaccctggccatggtgtcgatcacaacacttcacctcccggtcccttccccggcttccccggtttccccttcggagctcctcctccacacggcggacaccctccacaccagcctcacctgcctcaccagccgcatccacctccgcctccacctcccggagccgggcccggcccctggtgggatcaagctcccccggcttgggcttactggttcaacaacaacttcaacggcccgcctcgctacgacgaacatcccttctcgcaaaatgccggcgtgaatgctccccgagagggtgaagcctctcgcgaaaagaacaatgaagcgtcttcttcccccgaaaccatgcaagagggcgagccattccccgacccagcggaagtcacgccctcggaaagcgacgacgaagaagataacaaccaccgtcgtgacggcgttcctcctcccccttcgtatcccgccgagggcggacgacgtggacgaggtcgcggaggccacgctcacgcccacggccgcggt

SEQ ID NO: 6728 - DNA, 591 bp, Artificial
  Synthetic
tcatcctttaattctgttatcgcatatcctcaacgacagaaaatgctgttacgggcctatttgaacgaaaaccaccgagatttttgacggccctcagacaaaaagatgcctggacgaacaaaggcgcaggcggatgcctcatctcaggacgctgatatgcaggacgtcccgccgtctggacaagatgagatcaaccaggatgcggaaatgagagagaacgccgaggccgaggccgaggaggaagaggaagaggaagaggtcgagcctcagagagtgcgaattgtatgaccagagagttctagtatggctgagagaagcttgatttactaacggaggcgacagctccctggttcaacggacacagcggcttcgtttgagtttaccgatgaaggccatactttgggcaatgccctgagatatgttatcatgaagaaccctgatgttgaattttgcgcctactcaattcctcacccatctgagcccaagatgaacatcagaatacaaacttatggtaatattttatctcctctatcatgtgtgagtttccactgacgttcttgtctacagacggcacagccgtaaatgccttga

SEQ ID NO: 6729 - DNA, 585 bp, Artificial
  Synthetic
cccacgcgtcgcgacgacagcagctggtccaaatgccgcatgagccaccggcagcagcttctccactgggtggacatgggtcgcaatttcttccaccggcttgttctgcccaacgacgacgcccggggatcgagacctggacctcgccatcttgccagcactcagagatctttgatcagctctactgttgcccctctgccgccgccattggagctggatcatcatcacgtaagtctgatcttccactggaatcatttccgcaagcagaagcatctcctgtgacaaaagaagatcttggacgagctacgtggactcttcttcatacgctcgctgctcagtatcctgacaagcctacacgacagcagcaaagagatgtccgagacttgatgggaattgtttcccggatgtatccttgcaaagaatgtgcagaccatttcaaggaggtgctcaaatcgaatcctgtttccgctaactcgggcgtggagctatcgcagtggatgtgtcgagtgcacaacatcgtcaacagaagccttggaaaggcaaagttttcttgcgaacgagtggatgcgagatggggtgcactcc

SEQ ID NO: 6730 - DNA, 783 bp, Artificial; identical to SEQ ID NO: 4448
  Synthetic

SEQ ID NO: 6731 - DNA, 643 bp, Artificial; identical to SEQ ID NO: 5119
  Synthetic

SEQ ID NO: 6732 - DNA, 79 bp, Artificial; identical to SEQ ID NO: 4457
  Synthetic

SEQ ID NO: 6733 - DNA, 172 bp, Artificial
  Synthetic
tgtaacatgatgatatcggcgcaggggcgtatggacgacatgattctaatctggagagaagccgcattgtactgtattaactaaacattggatgaggatattatctggcgttttggattggcaaacgggaatacaaatggcgagtcatgaatgatcgaaaaaaaaaaaacca

SEQ ID NO: 6734 - DNA, 715 bp, Artificial
  Synthetic
atcggttgtcatgtccatcatatgtagattcacgcaaccatgacgtaggatgaagtcacatattatgtggagaatggtgcaagcctttcttagagagcgatgtatataagtgcaactgaacaacaactaattggatcgatgttaactgtgcaataatcgtcgtacgcgcagcaaagagtcgcgactagcagcatcgcaactgatatccgaataccgcgaaaaagaatagttaccaatcatgtcaggatactctaaagtcggcacatctggtgtctatgaggcaggtgatcagagaaatgttgcgagatcagagatgccgcaaccagagaaatacaacgagggtcaacatgcatcacacattggactcgattcaagtaaatgcattccctcaatcacattatgctgttgtttgtactaactcaagctcagaggatcaacgctccataaagaataggctggccgcagaagaggtaggttgtttgatctcgccagtggaatagtatctgacttgtttaaagcgaagagaagaggccggagatgaccttgagacgtcgttatcgaagaaggatccgacattaccagtcagtactcgattcccacaccatgaacccattagctaacaacgcaaaggccaagatgcatggcaatgagccatccaagggggccaaagtagacgctgaactaccagcagatgatgaagagtatctcaaaagga

SEQ ID NO: 6735 - DNA, 612 bp, Artificial
  Synthetic
gcggacgcgtggggtcacgactagcagcatttcaactgatatccgaataccgcgaaaaagaatagttaccaatcatgtcaggatactctaaagtcggcacatctggtgtctatgaggcaggtgatcagagaaatgttgcgagatcagagatgccgcaaccagagaaatacaacgagggtcaacatgcatcacacattggactcgattcaaaggatcaacgctccataaagaataggctggccgcagaagagcgaagagaagaggccggagatgaccttgagacgtcgttatcgaagaaggatccgacattaccagccaagatgcatggcaatgagccatccaagggggccaaagtagacgctgaactagcagcagatgatgaagagtatctcagaaggaagggcaaggcttaattggattcggttgggccgatatcatgtgtattcttaaatcaggattagaagtgaggcatggaaaagctgcggtctccctaagcacatgaggagttaataacggggagcaaggtgaacagagacgtttgaccatggacatgtctcactatgcctggccaaagataaaagaaagaaaagaaaaacaaagcgtattgcatgc

SEQ ID NO: 6736 - DNA, 1569 bp, Artificial
  Synthetic
cagctgtgacatgaattgttccgtcgtgaagcccctctccttgaacagcccctgctctcgatactggcagaagacgggatcatccttgtccagcacactcgaggtgccaacgctcacggcttcctcgccagcgcttaccatgtaaaagcttagtcggccctgtctctgagcatcagacatgatgagatccatgatggagatgtacagcatatccttgtacagcttgatgacggcctcatcgctgatgtcaggggtgaaggaggggtcaaccacttggccattctggtccacgactctgtacgtcggcagggctgtgtatgattcgggcgtctcaaacttgagagagctggtgaaggagctcttgagagcgccggggaacgacacaaatcccgaattgggccgttgcgagaggcttcccgcgctccggatgggattggagatgacggagacggacggctgagccagtctccggatggaggccctgcgaaggacgcgcgagttggccttgagcggacccacgcgtccgcccacgcgtccgcccacgcgtccgcggacgcgtgggacaaactccatctgcacaggaccgccatcagggactctgcacccccgatcagataaagcctctacctagcgctcaggacttgcagacggtcgccttgcatcgtctccaacgtccgcctaggatcttttgattctttctttgcctcctcgatccgagatcgatcttccaccacccttttagataccacataccctcatcacaatggccctgaagcgcatcaacaaggagctcaaggacctcggcactgacccgccatcatcctgctccgctggtcctgttggagaagatctgtttcactggcaagctacaatcatgggacccggtgattcaccatactcaggaggcgtcttcttcctgaagatccagttccctacggattaccccttcaagcccccgaaagtcaacttctccaccagaatctaccaccccaacatcaacagcaacggcagcatctgcctcgatattcttcgagaccagtggagccctgctctgaccatttccaaagttctcctttccatctgctctatgctgacagacccgaaccccgatgatccccttgtgcctgagattgcgcacgtgtacaagaccgaccggccccggtacgaggcgactgctagggaatggacccgcaagtacgccgtctaggcaataccaaacggtttcttttaaggggttttgatggcgctgggtgtttgacgtcctctatcacgcaatgacggtgcggcatgtttggcgagcctctacgttataagcgggtgcggggatgatattcgaaggcggacagtgcaagttttttctttcttctccttgctgttctcatcatctcttcgggtgcaccgcatttatgatgctgggggtgagacgacgcatggccggcggacaggtggcagactagacagaaatatccgctattcaagggcttatgcggctggacttgactttgggtttgcatcaacaacgtgtactctgcatccaacaacaggcatctgatttaacgcgtctatacg

SEQ ID NO: 6737 - DNA, 133 bp, Artificial
  Synthetic
tcgacccacgcgtcggctcaaggcaactcgcgcgtcttcgcagtgcctccatccggagactggctcagacgtaccgtctccgtcatactccaatcccataccggagcgcgggaagcctctcgcaacggcccaa

SEQ ID NO: 6738 - DNA, 632 bp, Artificial
  Synthetic
tcgaccacgcgtcggcaaaacatcctccgtgcaatgcactggctggtcaaggatgccagacccaatgactctctcttcttccactattccggccacggtgggcaaacaaaggatcttgacggcgatgagcctgatggatatgacgaagtcatttaccctgttgatttcaggcaacatggacatatcacagatgacgagatgcaccgcatcatggtcacccccctccaggcaggtgtaaggctgacagccatcttcgattcgtgccattctggcacagcactcgacctgccatacatctattctacacaaggtatcctcaaggagcccaacttggccaaggaggccggccagggcttgctcggcgtcatttcctcgtacagccagggagatctcggcggtgttgccaacaacatcatcggtttcttcaagaaggccaccacttggcgaaaaagcccacaaccgggccctcgcaaccaagacttctcctgccgacgtcgtcatgtggtccggaagcaaagacgaccaaacctctgccgatgctaccattgcttcacaagctactggtgccatgtcctgggcgtttgtcacggcgcccaggaagaaccccagcagagctacgtccagctgctcaa

SEQ ID NO: 6739 - DNA, 78 bp, Artificial; identical to SEQ ID NO: 4466
  Synthetic

SEQ ID NO: 6740 - DNA, 704 bp, Artificial
  Synthetic
cccggccggtctcctccgaaccctagcctgcttctcctcctcctccccgccgccgccgccgcgagcacagacgacgcagccatgtccgggaggaagaagacgcgagagcccaaggaggagaacgtgacgctcggccccacggtccgcgagggcgagtacgtcttcggcgtcgcgcacatcttcgcgtcgttcaacgacaccttcatccacgtgacggatctgtccggcagggagacgctcgtccgcatcaccggtggcatgaaggtgaaagctgaccgtgatgagtcatccccttatgctgccatgcttgcatcccaggatgttgcacagagatgcaaggagcttggaattactgctctgcacattaagctccgtgctactggtggaaacaagacaaaaactcctggtcctggtgctcaatctgcgcttagagctcttgcacgttctggcatgaagattggacgcattgaggatgttactccagtcccaactgacagtacccgcagaaagggtggcagaagaggaaggaggctgtaattccgtgtagtgcctgttatggggggaaagcaaagctatctatccttgtccttgcaacttgttctgtactctattatgatcttagcatcggatgtggatttataaattttgagctatgttatgttctttagaagatgaatgacctccccctataaagccgattatct

SEQ ID NO: 6741 - DNA, 594 bp, Artificial
  Synthetic
ccccccctcttctctcgtgtctccggcggcggcgagctcgtgatctcaacgaccaggaggaaaccggcgctcgcctcgatctccgccgcctcgtcccaccatgtcgaagaggaagaccagggagcccaaggaggagaacgtcactcttggacccactgtccgtgaaggagagtatgtgttcggagttgcccacatcttcgcatccttcaatgacactttcattcatgtcactgacttgtctggaagggaaactcttgttcgcattactggtggcatgaaggtcaaagctgaccgtgatgattcatcaccatatgcagctatgcttgcttctcaagatgttgcacagcgttgcaaggagcttggtattactgctctggacatcaagcttcgtgccactggaggcaacaagacaaagacacctggtcctggtgctcaatctgctcttagggctcttgctcgctctggcatgaagattggtcgcattgaggatgtgaccccggttcccacggacagcacccgcaaaaagggaggtaggagaggaaggaggctgtaaatgtattgtcagccaacttgtcgccatggagcatctcttct

SEQ ID NO: 6742 - DNA, 525 bp, Artificial
  Synthetic
aagatggcccccaagtcagacaacgttaccctcggcccccaggcccgagagggagagctcgttttcggcgttgcccgaatctttgcatccttcaacgatactttcgtccacatcaccgatctgaccggccgagagaccatctctcgagtcaccggcggtatgaaggtcaaggctgaccgagacgagaacaccccctacgccgccatgctggctgcccaggatgccgtcgagaaggctaaggaggttggtatcaacgctctgcacatccgaatccgagccaccggaggtacttccaccaagacccccggccccggctgccagtctgccgtccgagctcttgcccgagccggtatgcgaattggtcgaatcgaggacgtgacccccgttccctccgactctacccgacgaaagggtggtcgacgaggtcgacgactgtaagcggtttctttggggacttgctggcagtatttatgccgtgttttcatggtgtatgtaaaaatataaaagcgtaagcgtatttaacga

SEQ ID NO: 6743 - DNA, 535 bp, Artificial
  Synthetic
gcggaagtcggggcggcagcgagaatgtcgggcaagaagaggaccaaggaggtgaaagaggagacggtgacgttggggccgtctgtgcgggagggcgagatagtcttcggcgtcgcgcacatcttcgcttccttcaacgatacctttgtgcacgtcacagatctatcggggaaggaaactctggcccgagtcacaggtggtatgaaggtgaaagctgacagggacgaagcctctccttacgctgccatgctcgcggcccaggacgtcgccgctaaatgcaaggacttggggatcaacgcgctccacatcaaactacgagcaaccggcggcaacaagacaaagcagccaggacccggggcacagtctgctctccgtgctcttgctcgttccggcatgaagattggccgaatcgaggatgtgacgccgattccgactgacagcaccaggaggaagggtggtcgtaggggtcgccgtttgtagaaggcgaagcgtttactgtgatgttttttttccttatctaaaaacttctcgagct

SEQ ID NO: 6744 - DNA, 735 bp, Artificial
  Synthetic
caacagccccgtgacgaataaccagacgtcgacaaattcctcaaaatgcctcccaagaaggtcgccgctcctaaggagaacatctccctgggcccctctgcccgcgatggcgagctcgtcttcggcgttgctcgtatcttcgcctccttcaacgacaccttcgtccacgtcaccgatctgtccggccgtgaaaccatcacccgtgtcaccggtggaatgaaggtcaaggctgaccgtgacgagtcctccccctacgctgccatgttggctgcccaggacgtcgccgcccgctgcaaggagctcggcatcaacgctctgcacatcaagatccgtgccaccggtggtaacggcaccaagactcctggccccggtgcccagtctgctctccgtgccctggcccgtgctggcatgaagattggccgcattgaggacgttactcctaccccctccgactctacccgcagaaagggtggtcgccgtggtcgtcgtctgtaattgctgtatttttttttatacaaacaaaaaaagtacggcatctgcatgcttggcgaacctttggtttgggatcaaggcaggagtttcgctatctggttcttttatgtggcgttgagaaaaaacgaggagaacggcccttaaagcctggtctccaattctaccacgctctgctcaggttcctttgtcctttttactacaaagaaggatatatggcttgatgttgatgcagtagacagttac

SEQ ID NO: 6745 - DNA, 318 bp, Artificial
  Synthetic
gacttgaaaggagagagagagagagagagaggagagagagacacagagagagagagcttgttgcagagaagaaggtgtactgcagaaaatgtcgggcaggaagaaggtaagagaggtgaaggaggagaatgtaacccttggccctgctgtccgggaaggcgagcatgtctttggggttgctcacatctttgcgtccttcaatgatacatttgtgcatgtcacagatctctctggaaaggaaaccctgacccgagtcacaggtggcatgaaagtaaaggctgacagagatgagtcgtcgccatatgcggccatgcttgc

SEQ ID NO: 6746 - DNA, 777 bp, Artificial
  Synthetic
attcgctagctgtttcggtatctcttgagcttctcactaccaatcccagccgaagccatgtcgaggagaaagactagggagccaaaggaagagactgtaacacttggaccagctacaagggagggtgaattggtgttcggtgttgctcacatttttgcctctttcaacgatacttttattcatgtgactgatttgtctggaagagaaactatggttcgcattactggtggaatgaaggtgaaggctgatagagatgaatcttctccatatgctgccatgcttgcagctcaggatgtgtcacagcgatgcaaggaacttggaattaatgctcttcacattaagcttcgggctacaggaggcaacaagactaagactcctggtcctggtgcccagtctgctcttagggctttggctcgatctggcatgaaaattggacgtatagaggatgtgactccaattcccacagatagcactcgcagaaagggtggtagaaggggaaggaggctgtgaagatggttcgtttctgcagcataatgcaccttggaggattttgttgttgaggatgctcctttcaatttctttttacaattgatatctaaatactttgtagctgagacttttggtttcaaaccactttcattttgatctggccagctttgcgacataatgaagttttcttgaatttggcttcgttgatgttagtaggttgaatggtcaaacatatcctttcttaatgtgttggttaaagcttaatttcatcaaatttaaagttaagtc

SEQ ID NO: 6747 - DNA, 364 bp, Artificial
  Synthetic
ggccgctcgcgatctagaactagtctgcatctttcaatgacactttcattcatgtgactgatctctccggtagagaaactctcgtccgcatcaccggtggcatgaaggtgaaggctgaccgtgatgagtcctctccttatgctgctatgcttgcagctcaagatgttgctcaaagatgcaaggagcttggcatcactgccatgcacgtgaagctccgtgctactggaggaaacaaaaccaagactccaggtcctggtgctcagtctgctcttagagcccttgctcgttctggcatgaagattggtcgtattgaggatgtgactccgattcccacagacagtacacgccgaaagggtggacgaag

SEQ ID NO: 6748 - DNA, 622 bp, Artificial
  Synthetic
cccatcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagtcccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattaccatcggtactccccctcagaccttcaaggttgtccttgacactggaagctccaacctttgggttccctcccagtcgtgcaacagcattgcctgcttcctgcattccacgtacgattcgtcctcctcgaagacgtacaagcagaatggatccgacttcgagatccactacggatcaggcagcttgactggcttcatctccaatgatgtcgtcaccattggtgacctcaagatcgagaagcaggactttgccgaggctaccagcgagcccggccttgcctttgctttcggtcgcttcgacg

SEQ ID NO: 6749 - DNA, 579 bp, Artificial
  Synthetic
agctggataaatttctcctgtcatcctcatttcgctgccctgcgccacgacaccggctgctgcagtcccttttctaggcgatacccagcatctgcactctgcccttttttatattctctcctttgaaactcgcattctcgtcgcgatagctattccagcggttgccctaactttctatttgcatcacataacctgacaaaatgggtgaatccagacaagagctcctcaattggctgaacagcctccttcagcttaacatgaccaaggtcgagcagtgcggaactggcgctgcgctctgccaggtctttgacagcatatacatggacgtgcctatgtccaaggtcaagttcaacgtcagcggcgattacgcctacatccaaaacttcaaagttttgcagaacacgttcctcaagcaccaggtcgataagcccatccccgtcgaatcgttggtgaaatgtaagatgcaagacaacctagagttcttgcaatggacgaagaagttctgggacctcaacttccccgaccacgattacgacgctgttgcacgaagaaaggctggcggttgcgcccgcagccagt

SEQ ID NO: 6750 - DNA, 559 bp, Artificial; identical to SEQ ID NO: 5146
  Synthetic

SEQ ID NO: 6751 - DNA, 483 bp, Artificial
  Synthetic
acccacgcgtccgaaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacac

SEQ ID NO: 6752 - DNA, 656 bp, Artificial
  Synthetic
ggaaagaaaccctcaattttgtcgtaggagtagtgtgttagtgcgtgcagtgatgggtgccgagagaggcgaaggcggcggtgcgcatggcggcatggttcggctgcagtgcaaggtgcagcactacgactggggccgaattggcggcgacagcgaggtgggtcgcctgcacgcgctcatgagcggcagccccgtggatgccgacgcgccctacgccgagctctggatggggacgcattcgtcgggtccatccgcggtgctgctgcccgaggatggcggaggagatcaaatgctgctcagggagtggctccagcgccaccccgaggcactcggcgatcaagtactcaggcgctggaatggagatctgccttttctcttcaaggtgttgtcggtggcaaaggccctgtcgatccaagcgcacccggacaagaagctggccgagtatttgcatgggaagtacccccaagtgtacaaggacgataaccacaagccggaattggcgttggcgctcactcgcttcggggcattgtgtggattcgtgactttcaaggagctccaggcgacgctggaatccgttccggagctgcgtgacgctctaggaccggtagtggtggagagtgtccttgccagtagctctagccaagaaggcggaaaca

SEQ ID NO: 6753 - DNA, 485 bp, Artificial
  Synthetic
agattcagaattggggtagctgctccgtagagagtcactggcacgatgaattaaaccgccacttgttcggcttggcagcggtaatcgctggaggagacacggaagacatggaactgcagtgagcaacgacacagccatgcagtgagacccacggccacgcgcgtcctcgggagcatacctgggaaccgaccggatagcggcatctcaggacacgaggatcgtctgcattgtgtacaggtcgaatgcgggttgaagccagcaggcgcaaaaccccatcatctctgtataagctgtacgatagggtattgcagcccgaaaatctcgtagatttgtatcgaacggcatccgtgtagctcgaggcgtggacgccggagatttctgcaagtccgggtagcatctctcggaaatcttttaggtagtcttggctttcatttcgttttggcagcaaagcctcatattgccatggatcgaatcgtacgagggcg

SEQ ID NO: 6754 - DNA, 583 bp, Artificial
  Synthetic
aacttccggcaagatgaagatcgaattgtgtgtatttagtgggtctaaaatatatccaggccatgggatgagaatcgtcaaagccgatggcaagacgtaccagttccttaatggcaaatgtgcgaaggcccacatggccaagcgtaacccacgtaaggtgaactggaccgtgctgtaccgtcgcaagcacaagaagggtttgacagaggaggtcaccaagaagaggacacgtcgcacgacaaagtaccagcgtgccattcagggtgctaccatcaatgacatcctcgccaagcgtaaccagaaacccgaggtcaggcaggctcagcgtgaacaggctatcagggcggccaaggagaagcaaaaggctaaggatgctacaaagaaagccaccaagccggcccaggcgaaaactcagccgaagcagaaaattcagaaggcagcgcccaagagtcagccgcgtgttgccgtcaggcgataaacgaactgaaagtaaaaacgacacctcagttggacattcactgttggacattcagttatcgagggatataagtgctcattacacatataacagcagatagctaaa

SEQ ID NO: 6755 - DNA, 544 bp, Artificial
  Synthetic
tttggactgtaggctgtagaggagtatggagccgttgtgtgcctctgtctgacattggaggattctggatccattgtgtgcctctatctggcattggaggagtctggagttgctgtgtgcccctgtctggcagtggaggagtgcggtgttgctgtgtgctcttgtctcgtcggcgaagcatcagtgtagcctgagcaggtgccgtaaagaccggtgctacgggcaactgtgggagcttgggaggaaggacaaacggttttgccgcctctggatgcttttccaagaacgcttgttcatattgaccaaccccgaagaactcgtccaagtcgctcagagtaggagagggttgttttcgttgctgagactgagagccattagttggtgaagcagcattatacatttcattcatagagcgagaaggtcttggttccgcgcgctgggctgcgtagcttgtttgtttgcttagcccaggcttggatggagtgataacggctgaaattgaactgcttgagtcggagctacccgatagatttcgcgggattct

SEQ ID NO: 6756 - DNA, 616 bp, Artificial; identical to SEQ ID NO: 4514
  Synthetic

SEQ ID NO: 6757 - DNA, 534 bp, Artificial
  Synthetic
ccccccccggacgccactcacgatcgcgagctcgacagcttctacgtctagcatcgagtggatcgaacaatggcaactttgcttcaggaacctgcaccgctcgttcaggcggatcagagccaggtcgacctcgccgaatatgatgaggagcaggtccgtctgatggaagagcgctgcattctggtcgaccccgaggatgttgcttacggcgaagagagcaagaagacttgtcatctcatgagcaacatcaagcaaggcttgcttcatcgcgccttttccgtcttcctcttccgcccaagcgacggcaagctcttgctgcaaaagcgggcggacgagaagatcacgttcccaggcatgtggaccaacacatgctgcagtcatcctctgagtacaaaagaggaccgtgtcgaggaggggcaattgggcgtgcggaaagcgggtattcgcaagcttccgcacgagctcggcatcaagccggacgcgctcagtcccgaagactttgtctacttgactcgcatacactaccaggccggc

SEQ ID NO: 6758 - DNA, 326 bp, Artificial; identical to SEQ ID NO: 5157
  Synthetic

SEQ ID NO: 6759 - DNA, 643 bp, Artificial
  Synthetic
tggccaccaccgttcccgctcacacacactgcaagcaaccatggcattcggcaagctctacagctacgcgggcaacccgcgcaccacgtcgctcctggctgtcgcgaaggagaacgggctcgacatcgagtttgtcgacacagagcccgccaagggcgtgtcggccgagtacctgaagctcaacaagctcggcaaggtgcccacgttcgagggcactgacggctttgtgctctccgagtcgatcgccatcgccgtctacctcgcctcgcagaacgagaagaccagcctcctcggcaagaccaagcaggactacgccaccatcctgcgatggatgtcctttgccaactctgaggtcctctctcccctcggcggctggttccgccccatcctcggccgcgacccctacaacaagaagaacgtcgacgaggcccagaaggcttctctcaaggccgtcaacgtcttcgaggagcacctcgccacccacacgtaccttgtgggcgagcgtctgacgctcgccgacctgttcgctacgagcgtcctcgcccgtggctaccagtacttcttcgatgcgaagtggcgcgaggagaaccccaacgtcacccgctggtacgagaccatctacaaccaggccagctacttggct

SEQ ID NO: 6760 - DNA, 637 bp, Artificial
  Synthetic
acgacctccagaccccccgatacacttctatcaaggccctcatcaagcacttcaagctcgatgttgaggttgtccccaaggacgccgagttcgagaagctcttccctctcaagaaggtccctgccctcctgaccgccaacggcactcccatccacgagttcgttgccgtctcctactggctcctctcccagatccccaaccaccctctttgcggaaagaacaaggacgaggaggctgaggttctccagtgggtctcttttaccaactccgatattgcggatgccacctggaacgttttcggccctctcaagggctaccttccttacaacaagaaggctgtcgatgctctctctgacaagctcgaccagaccgtcaaggctacctttgaggcccacctcaccaagaacacctaccttgtcggcgagtctgtcacttacgctgatatcgccgctgtcggcctgatgtctcttggatttgctaacctctttgacgccaagtggcgagctgcctaccccgctaccacccgatggttcaccaccgtcgctgccaaccccatctactctggcaccgactttaacctctgtgaggagcgagtcaagtacgtcgcccccaagaaggaggagcctaagaaggaggc

SEQ ID NO: 6761 - DNA, 649 bp, Artificial
  Synthetic
ggtcaccaccgttgcgcttccatcgcagaaactcgctgcggaatcaaccactgcaatatgtcttatcaacggatatggccagccctacggccaaccaccgcctccccagggctatggccagtatccccctcctcaacagggccaatatcctcctcaacagcagggccagtaccctcctcctcatgggcaatatcctccggcccagcaagggcaatacggccagcatcctccccctcagcagggaggttattaccagtctcccccgccccctccaggccagtatcccccaccacaagcgccctacggacagccgccgcctcagcaatacggggctcctcctcctcaacaccaacagccctacggagcgcctcctccaggccaatatggagcgcctcctccgcagcatggagggcattatggtgcccctcctccggcgccttacggagctcccccagtgcagcctacgccgccgtctattggctatggcgcaccccagatcattcaatgggacggcaccccagatgcccaggctttgcgcggcgccatgaagggctttggaacggacgagaagacactgattaatgttctctcgcgaaaagacccgctacagatcgaggtgattcgatccacttacgagcgcaccttcaag

SEQ ID NO: 6762 - DNA, 493 bp, Artificial
  Synthetic
gcgcctatcaatccgataccccgccgccttcagattcctttcctcagcatccgtcaaaatggctgaccgcgtccaccgaatcaccatgttcaagctccctagcgaggagagccagaagaagctcattgaggagtacaagaccctcaaggagaacaaccgaaaggacggccacccttacatcctctccatagccgctggtcccgccgagcccgaccagcgctcccagggcttcacctttgtctcaaagtccgagtttgccagcctcgaggacatgaagtactacgacgaggagtgtgtggcccaccaggccctcaagaaggtcgccatgactctgggtgttgagggcatcatgaccatctacttcaagccccaggtcgtcggtggtgttgcgccctgaaaaaaggccattctgatggagccggggacaaaatattcgatgcaagtaagcgcttgcattgagatgaaaatagacgcccgcctctagaagaagacc

SEQ ID NO: 6763 - DNA, 353 bp, Artificial
  Synthetic
cccacgcgtccgcttctcttcttcttcttcaagccgcggctaaagatccctacttctctcgacacttatagagtttcagtcatggccgcctccgcagaaatcgacgctgagattcaacagcagcttaccaatgaggttaagctcttcaaccgttggagctttgatgacgtttcggttacggatattagtcttgtggactacattggtgttcagccatcgaagcacgcaacttttgttccccatactgctggacgatactctgtgaagaggttcagaaaggcgcagtgcccaattgttgagaggctcactaactctctcatgatgcacggaagaaacaatggtaagaagttgat

SEQ ID NO: 6764 - DNA, 701 bp, Artificial
  Synthetic
tagggttgtgggtttttagggttcttgagcagctatggcggcggtggtgttgcccgagaagcaaaagccgatcttgtacgtcgatgtgaagctcttcaatcagtgggcttatgatgaagtggaggtcactgacattcctctacaagactacatcgcgtctcggcagacgacttatgtgccacacacggccgggcgctactccaagaagaggtttaggaaggctcagtgccccatcgttgagaggcttaccaactcgctcatgatgcacgggcgaaacaatggaaagaagctcatggctgggcgcattgtgaagcacgcgatggagatcattcacttgctcactgaccagaacccgatccaagttatcgtcgatgctatcatcaacagtggtcctcgcgaagatgctactcgtatcggttccgctggtgttatccggcgtcaggctgtggatatctcgcctctgaggcgcgtcaaccaagcgatctatttgctgaccaccggagctcgcgagagtgctttccggaacatcaagaccatcgcggaatgccttgccgatgagctcatcaatgccgcgaagggatcgtctaacagctatgcgatcaagaagaaggacgagatcgagcgtgttgccaaggcaaatcgttgaaaagtttttctccagaggtctctttttattgtcgagtattaaacacagaaacaca

SEQ ID NO: 6765 - DNA, 642 bp, Artificial
  Synthetic
gagcagccatggcggcggtggtgttgcccgagaagcaaaagccgatcttgtacgtcgatgtgaagctcttcaatcagtgggcttatgatgaagtggaggtcactgacattcctctacaagactacatcgcgtctcggcagacgacttatgtgccacacacggccgggcgctactccaagaagaggtttaggaaggctcagtgccccatcgttgagaggcttaccaactcgctcatgatgcacgggcgaaacaatggaaagaagctcatggctgggcgcattgtgaagcacgcgatggagatcattcacttgctcactgaccagaacccgatccaagttatcgtcgatgctatcatcaacagtggtcctcgcgaagatgctactcgtatcggttccgctggtgttatccggcgtcaggctgtggatatctcgcctctgaggcgcgtcaaccaagcgatctatttgctgaccaccggagctcgcgagagtgctttccggaacatcaagaccatcgcggaatgccttgccgatgagctcatcaatgccgcgaagggatcgtctaacagctatgcgatcaagaagaaggacgagatcgagcgtgttgccaaggcaaatcgttgaaaagttttcctccagtggtctc

SEQ ID NO: 6766 - DNA, 681 bp, Artificial
  Synthetic
tgaaaacctagaggggagggagcgtacgtaggagagagggcaagggcataatagctatggccgtcgtgcagcagcctgacgtcaagctcttcggtcaatggtctttcgaagacgtcgagatcagtgacatttcccttggtgattacattgctgtgtctgttgacaagcatgcgacatttgttccccacaccgctggccgctactctgcaaagcgcttcaggaagtctcaatgccccattgttgaaaggctcaccaactctttgatgatgcacgggcgcaacaatggaaaaaagctgatggctgtgcgtatcatcaagcatgccatggagatcatccaccttctcactgatcagaacccaatccaggtcattgtcgatgcaatcatcaacagtggacctcgagaagatgctaccagaatcggatctgctggtgttgtgaggagacaagctgttgatatttcgcctttgaggagagtgaatcaggccatatacttgcttactactggtgctcgagagagtgccttcagaaatatcaagacaattgctgaatgccttgcggatgagctaatcaatgcagcaaaaggttcctcaaacagctatgcaatcaagaagaaagatgaaatcgagcgcgttgcaaaggcaaaccgttaaagcttcctgatttttttagtttggctgagga

SEQ ID NO: 6767 - DNA, 642 bp, Artificial
  Synthetic
cggccgcgactcgttaggctactccacccactcttgtttagggtttccctcagccgccgccgccgcatccacgctcagcagccatggcggtggtcgagcagccgcagcagcaggtggtgaagctcttcaactgctggtccttcgaagacgttcaggtgaacgacatatccctcgccgactacctcgcggtgtcctcgacgaagcacgccacctacctgccgcacacggctggccgctactcggcgaagcgcttccgcaaggcgcagtgccccctcgtggagcgcctcaccaactccctcatgatgcacggccgcaacaacggcaagaagatcatggctgtccgcatcgtcaagcacgccatggagatcatccacctcctcaccgacgccaaccccatccaggtcatcgtagatgccatcatcaacagcggcccgcgtgaggacgcaacccgtatcggctctgctggcgctgtgaggaggcaggctgtggatatctctcccttgaggagggtcaaccaggcaatctacctcctcaccactggcgccagggagagtgcctttaggaacatcaagaccattgctgagtgccttgctgatgagctcatcaatgccgccaagggctcatccaacagctatgccatca

SEQ ID NO: 6768 - DNA, 798 bp, Artificial
  Synthetic
cggacgcgtgggcggacgcgtgggcgccgccgccgcctcccgcatccacgcgcctcctcctcctccggcggcgccgccgccaccgcagcatcagccatggccgaagtggagctcccgcagcaggaggtcaagctcttcagccgctggtccttcgaggacgtccaggtgaacgacatctcgctggcggactacctggcggtgaacccgacgaagcacgcgacgtacctgccgcacacggcggggaggtactcggcgaagaggttccggaaggcgcagtgccccatcgtggagcgcctgaccaactcgctcatgatgcacggccgcaacaacgggaagaagatcatggccgtgcgcatcgtcaagcacgccatggagatcatccacctcctcaccgacgccaaccccattcaggtcatcgtcgacgccatcatcaacagtggccctcgtgaggatgcgacccgtattgggtctgcgggtgctgtgaggaggcaggctgtggatatctctcccttgaggagggtcaaccaggcaatctacctcctcaccactggtgccagggagagcgccttcaggaacatcaagaccattgctgagtgccttgctgacgagcttattaatgccgccaagggctcatccaacagctatgccatcaagaagaaggatgagatcgagcgtgttgccaaggccaaccgttgagtggtgatcccatgtcattgtgctaaagctcttgcgctgtttggcaggactatactttttgctagtaatttaagccttttcagacctacctgtggtttaatg

SEQ ID NO: 6769 - DNA, 670 bp, Artificial
  Synthetic
gccagtacctcaactacacagtacgacaccatggccgacgaaaccgcccctgttgctcttgccctccagctccccaaggacatcatcgccgagtccggctccgtcaagctcttcaacaagtggacctacgacgacgttgaggtcaaggacatttctctcaccgactatgtccagatctcccagcccgtttacatcccccacaccgccggccgatacgccaacaagcgtttccgaaaggcccagtgccccattgtcgagcgactcaccaacgctctgatgatgaacggccgaaacaacggtaagaagctcaaggctgtccgaatcgtcgagcacgctctggagatcatccacctgctcaccgacctcaaccccctgcaggttgttgttgacgccatcatcaactgcggtccccgagaggactccacccgaatcggttcctccggtgccgttcgacgacaggccgtcgatgtctctcctctgcgacgagtcaaccaggccatctctctgctcaccatcggtgcccgagaggccgctttccgaaacatcaagaccattgctgagtgtcttgctgaggagctcatcaacgccggaaagggttcttccaactcttacgctatcaagaagaaggacgagcttgagcgagtcgccaagtctaaccgataaggtgatg

SEQ ID NO: 6770 - DNA, 409 bp, Artificial
  Synthetic
tccttcctctaaccacccaaatcgcaatcatgtctgacggagaaatcgaggtcgagagccccgccggctacgccgtgctccccaaggaggtcaccgacgagattggcagcgtcaagctgttcaacaagtggtcctacgaggaggtcgaagttcgcgacatctctttgaccgactacatccaaatccgctcgcccgtctacatctcacattccgccggccgctatgccgtcaagcgattcaggaaggcgcagtgccccatcattgagcgtctcaccaactccctcatgatgaatggccgcaacaacggaaagaagctcatggctgtgcgcatcgttgctcacgctttcgagatcattcacatcatgaccgagcagaaccccatccaggttgccgttgatgccatcgtcaa

SEQ ID NO: 6771 - DNA, 671 bp, Artificial
  Synthetic
gctcgacaatccgcaatactaaccgcagtcccgcccagcaccggaattttcgactgcaaatagcccaagatgtctgacggcggtgaaatcgagatcgagaactctgtcgttaccgacgtcctccccaaggacattgtgaaggaggttggcaacgtcaagctgttcaacaagtgggactacgatgtcgaggtccgcgacatctctctgaccgactacatttccctgcgaaaccccgtctacgtcacccactctgctggccgatatgccgtcaagcgattccgcaaggccaactgccctatcattgagcggttgaccaactcgctcatgatgcacggccgcaacaacggcaagaagctgatggctgtccgcatcgtcgctcacgccttcgagatcattcacctcatgaccgaccagaaccccatccaggttgccgttgacgccattgtcaactgcggtccccgtgaagactctacccgaattggctctgccggtaccgtccgtcgtcaggccgtcgatgtctcccccctgaggagagtcaaccaggccattgccctgctcaccaccggtgcccgcgaggctgctttccgcaacgtcaagtccattgctgagtgcttggctgaggagctgatcaacgccgccaagggcagcagcaactcatacgctatcaagaa

SEQ ID NO: 6772 - DNA, 725 bp, Artificial
  Synthetic
tgaaaacctagaggggagggagcgtacgtaggagagagggcaagggcataatagctatggccgtcgtgcagcagcctgacgtcaagctcttcggtcaatggtctttcgaagacgtcgagatcagtgacatttcccttggtgattacattgctgtgtctgttgacaagcatgcgacatttgttccccacaccgctggccgctactctgcaaagcgcttcaggaagtctcaatgccccattgttgaaaggctcaccaactctttgatgatgcacgggcgcaacaatggaaaaaagctgatggctgtgcgtatcatcaagcatgccatggagatcatccaccttctcactgatcagaacccaatccaggtcattgtcgatgcaatcatcaacagtggacctcgagaagatgctaccagaatcggatctgctggtgttgtgaggagacaagctgttgatatttcgcctttgaggagagtgaatcaggccatatacttgcttactactggtgctcgagagagtgccttcagaaatatcaagacaattgctgaatgccttgcggatgagctaatcaatgcagcaaaaggttcctcaaacagctatgcaatcaagaagaaagatgaaatcgagcgcgttgcaaaggcaaaccgttaaagcttcctgatttttttagtttggctgaggagaacttgggttcttatttggtatcccgaggaagttttaaaaact

SEQ ID NO: 6773 - DNA, 867 bp, Artificial
  Synthetic
gcagcagcggcactagacagcagcaaagactcctcccctaaggtgaagaattggagcagagaagaaaaaatggacgcaggtgtagtagccgccccagtagacgcaaccgcagagaataagatacacagtgatgttatgcttttcaatcgctggacctacgacgatgtccagatcaatgacatctctgttgaggattacatcacagcaactgcttccaagcatccagtttatatgccacacacagctggtagataccaggctaagcgtttcaggaaggcccagtgcccaattgttgagaggctcaccaactctcttatgatgcatggacggaacaatgggaagaagctaatggctgtccgcatcatcaaacatgcaatggagatcattcatttgttgactgaccagaacccaatccaagtcattgttgatgccgtcattaacagtgggccaagggaagatgcaactcgtattggttcagctggtgttgtgaggcgtcaggctgttgatatttctccacttcgccgtgttaaccaggccatttatttgctgacaactggtgcacgtgagagtgctttcaggaacatcaagaccatagctgagtgccttgcagatgaacttatcaatgctgccaagggttcttcaaacagctatgccattaaaaagaaggatgagattgaaagagttgccaaggccaatcgttgagaggttgacattgtaacagaatttacaaggtagtttagggttatgctattttctcatttctgttttcttttagcactatagtctcatggaaatgaaagtggatctgagtagcaccacagctattgcatgtggattttaatttagtattttgcttgttgaaacttg

SEQ ID NO: 6774 - DNA, 870 bp, Artificial
  Synthetic
cccccggcgactcgttaggctactccacccagtcttgtttagggtttccctcagccgccgccgccgcatccacgctcagcagccatggcggtggtcgagcagccgcagcagcaggtggtgaagctcttcaactgctggtccttcgaagacgttcaggtgaacgacatatccctcgccgactacctcgcggtgtcctcgacgaagcacgccacctacctgccgcacacggctggccgctactcggcgaagcgcttccgcaaggcgcagtgccccctcgtggagcgcctcaccaactccctcatgatgcacggccgcaacaacggcaagaagatcatggctgtccgcatcgtcaagcacgccatggagatcatccacctcctcaccgacgccaaccccatccaggtcatcgtagatgccatcatcaacagcggcccgcgtgaggacgcaacccgtatcggctctgctggcgctgtgaggaggcaggctgtggatatctctcccttgaggagggtcaaccaggcaatctacctcctcaccactggcgccagggagagtgcctttaggaacatcaagaccattgctgagtgccttgctgatgagctcatcaatgccgccaagggctcatccaacagctatgccatcaagaagaaggatgagattgagcgtgttgccaaggcgaaccgttgagtgctgaacccatctcagtgtgctcgagctattgccttgcactgttgccagtactttttgctagtctttttgggctttgccagagttacctgtgattttctgtttaatgataagtgctgagaaaatgtagtagtctgttcgctatcgacattgttttattacacccccaatccttgttcctgc

SEQ ID NO: 6775 - DNA, 629 bp, Artificial
  Synthetic
gaaagaggaaagaggagagaggagagagagaggaggaggaggaggaggagcgatggcggtcgcaacgcagcaacccgatgtcaagctcttcggacaatggtccttcgaagaagtcgagatcagcgacatctcgctggcggattacattgcagtatctgtcgacaagcatgcgacattccttccccatacggctggacgttactccgcaaagcgcttcagaaagtcacagtgccctattattgagaggttaacaaactccctgatgatgcacggtcgcaacaatggtaagaagcttatggctgtccggattgtgaagcacgccatggagatcattcacctcctcacagaccagaaccccattcaagtcattgttgacgcaatcatcaacagtgggcctcgggaggatgctactagaattggttctgctggagttgtgagaaggcaagctgttgatatttcccctctgcgaagggtaaatcaggctatctacttgcttaccactggtgcacgagaaagtgccttcagaaacatcaaaacaattgctgaatgcctagcggatgagcttatcaatgctgcaaaaggctcttccaacagctacgcaattaagaaaaaagatgaaattgaacgtg

SEQ ID NO: 6776 - DNA, 893 bp, Artificial
  Synthetic
ctcgtttagggtttccctccgccgccgccgcctcccgcatccacgcgcctcctcctcctccgccgccgccgccgccaccgcagcatcagccatggccgaagtggagctcccgcagcaggaggtcaagctcttcagccgctggtccttcgaggacgtccaggtgaacgacatctcgctggcggactacctggcggtgaacccgacgaagcacgcgacgtacctgccgcacacggcggggaggtactcggcgaagaggttccggaaggcgcagtgccccattgtggagcgcctgaccaactcgctcatgatgcacggccgcaacaacgggaagaagatcatggccgtgcgcatcgtcaagcacgccatggagatcatccacctcctcaccgacgccaaccccattcaggtcatcgtcgacgccatcatcaacagtggccctcgtgaggatgcgacccgtattgggtctgcgggtgctgtgaggaggcaggctgtggatatctctcccttgaggagggtcaaccaggcaatctacctcctcaccactggtgccagggagagcgccttcaggaacatcaagaccattgctgagtgccttgctgacgagcttattaatgccgccaagggctcatccaacagctatgccatcaagaagaaggatgagatcgagcgtgttgccaaggccaaccgttgagtggtgatcccatgtcattgtgctaaagctcttgcgctgtttggcaggactatactttttgctagtaatttaagccttttcagacctacctgtggtttaatgtttgaatgaacatcgactagtgctgagaaaaatatgtagtgctctattctatctatctatcgacatggttttatattgaacccgcaattcccgttccttc

SEQ ID NO: 6777 - DNA, 367 bp, Artificial
  Synthetic
cccacgcgtccgggaggaacaacggtaagaaattgatggctgtcaggatcgtcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcagccaagggctcttccaacagctatgccatcaagaagaaggatgagattgaaag

SEQ ID NO: 6778 - DNA, 519 bp, Artificial
  Synthetic
cgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcgtcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatc

SEQ ID NO: 6779 - DNA, 1791 bp, Artificial
  Synthetic
cacacctgcaagccgtcggctcttccttcctattcccattgacaggataaacatacgtctaggctgcttctgcttggcaggaactacctttccgagcatctgccactgcctatctgggtattgggcattgcccaacgtggtgcgcacttgctcgatccatacctacaattacgggtaccttgatgatctggggtatcttgtagtttagtttgtatctgccgggtcacgagcagccaccaccgccaacatttggtactaggcaatacttctgggtgccgatatatcacctgtcacgtcttttcaggttttgcatctttttgctctcttcatcatcatcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggtttttcgtcgaccactgaggcttagtgcccatcagccactaaagcggcttgacgtcgattctcaactttgaacccttttgagctgcctctggcctctgcctcatctctcccacaccctcacgcgcgcagtcttgaatcaacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgccgaggccgccgttgctgacatgcttgcctggttccgcaccggcggcgtcgtcggcatccttgacgcgaccaattctacaaaggagcgccgtaaatgggtcatggacacgtgcaccgctcacggcattgaagtgctctttgtcgagagcaaatgcgatgatgaagaggtcatcatggccaatatccgtgacgtcaagctaacgagccccgactatcgaggccaagatcccgaggccgcggcgcaagactttcgcaatcgcatcagccactacgagaaagtttacaagaccatcaacgccgacgaggatgaggacaactacacctacctaaagctgatgaacgtcggcaagcaagtcatca

SEQ ID NO: 6780 - DNA, 581 bp, Artificial
  Synthetic
cccacgcgtccggcggtacgaagccacctttgctgttaatggcgcatatataaaactcgaaaatagaggagaaaataggaaaaagagacaaaaaaactaacaagatataaacaaacaacaggcacacattgacagtggcaaaactacggtaacggaacgagttctcttctacactggtcgaatcaaggcaatccacgaagtccgcggcaaagatgccgtcggcgccaagatggactctatggaactggaacgagaaaagggtatcacgattcagtctgcggctacattctgcgactggaagaaaacggtaaacggaaaggatgaagagtatcacatcaacttgatcgacactcccggccacattgacttcaccatcgaggtcgagcgtgctttgcgcgtgctcgatggtgccgtcatgattctctgcgctgtctccgctgttcagtcccaaacgattacggtcgatcgccaaatgaagcgctacgatgttcctaggattttcattcatcaacaagatggaccgcatgggtgccaacccctggaaggccgtcgagcagatcaactccaagctcaagatcccc

SEQ ID NO: 6781 - DNA, 722 bp, Artificial
  Synthetic
gcgatgtggttcacttagctcattgtcggcgagagatggcggcgatggcgcaatctcttccggcagctaggttctcctcgccgcgctcatcgattccttccagctcgcaagcgaggctatgctgctgcgccgctgccagatcgcgagcgccattcgtggtgctcgatagcttgttcttgccagggcttggattctcactcagaaatgcgaggattggcgatgctgccactgtggcgaggcgtggaatcgtgtgtatggcggccgattccggcacacgagagtttcctctcgaggactaccgaaacattggaatcatggcacacatcgacgctggaaaaaccaccacaacggaacgcatcctttactacaccggcaagaactacaagatcggtgaagtccacgaaggcaacgcaaccatggactggatggaacaggaacgagagcgaggcatcaccataacttccgccggcaccaccggcgtatggaaagaccaccggatcaacatcatcgataccccgggtcacgtcgacttcactctcgaagtagagcgagccttgcgagttttggatggagctatctgtctcttcgacagcgttgccggggtggagccacagtccgagacggtgtggagacaggcagacaagtatggcgttccaaggatatgtttcgtgaacaagatggatcgaatgggagccaacttcttccggacgagagacatgatc

SEQ ID NO: 6782 - DNA, 589 bp, Artificial
  Synthetic
gttttgttaggagccgttgtattcatcacacaagacctgcgtctttgttgggcagagattttcaatcccattcatgaaccaaaatacaaagcaactgaaaatttctcccgtccgccggcttgagcttgacacatgcagcgaacctgcatccgcaagcccaaaaagcaaataatggcaccccctgggctttggagcttctggatttcattggcgccgctcaagttagccgcacccaccggcgaaccccagaatggcggccggggttgggactagagggactaggggaataccttgcgcgtctgtgagattggtgaggccgggcagagtagacggcatgtatagtacagtacagacgaagttttccaaccgggatgctgcttgcttgggggatcgtcgtgctggagatgttggcacttgtagaccctcaccggtgaggagctgtgggtaaaagatgccagtgagtggatggaggtgaagaaccagctttgggacttgaaggatcgtaacccggtccagcctggaaagccggcgcccctcttggcaaatcactgccgcaatctagtgaattgacctgcaggccgatgctgta

SEQ ID NO: 6783 - DNA, 214 bp, Artificial
  Synthetic
gctctggctatggcggcggcggcggctacggaggcggttacggcaacggtggcagctacggcaaccccggcggtgctggagcccagtcctcgtggtggtaaatactcacgctctctcgtgatgggcatatcactgtgtctatcattgtggctcaagtttcagccactactctttttttttttctcgtcttcacttttcccttatcgtcatttat

SEQ ID NO: 6784 - DNA, 549 bp, Artificial; identical to SEQ ID NO: 4552
  Synthetic

SEQ ID NO: 6785 - DNA, 818 bp, Artificial
  Synthetic
gcgcgtggtatatcagcccaatcttactatggagtccaacatggtgcatgttcagggcgcatgtgctggtagcatatcgtcaacggacggggagaaaagtacggaggacgtccgctgtggttctcctcggatgcgggcgttggtaggccaccagcgtcctaaatcttgatcccaacggatctggcaacgcagtggaaatggggccgatggagaagttcggaacgggcagccaacatgtcaactacccactcatgccaccagtcccgctgcatcgccaggaacgttggccccaatgccgaagtaagtgtgcggacagaatggataccagcggccaccgtggtcctttccagcgttacacaaaagccctattcgtgcgttcaattctgccacgatcgatcgggtggtcccagaaggttggaatccaggttggcgtgctagagcgcaagaagaaaaaaaggcgagcaaaatgaataaaagagcatcccacccaccaactttggcaaacagcgcaacggcgcatttttgatttgttgatttgtcgacaatgcgattgtcacagacaatatgtctcggattctcaagagaaccaaccacacacatggcggtaaacagtatgtcattcgggttcccaatttgagcagttccgggttggaacaaaacacagacgacagggatttcctgtgattgatgcgcgtttgaatcgtgatcctgctccgaagggagcatctggtaccccaagtagagtacaagttgcagtagactgcagccgtctcaggatactcagatgtgcgcgcgcattgcaaatcttcagcacgaac

SEQ ID NO: 6786 - DNA, 479 bp, Artificial; identical to SEQ ID NO: 4450
  Synthetic

SEQ ID NO: 6787 - DNA, 950 bp, Artificial
  Synthetic
gggaaatttgttcaacctcgacaaatcaaccccgtcgcccatagtacaagatggtaagttaacagtcaaccaaaagactctaatggccacagtttgtgagtcaaatgcgcgaaagcgcaattgatgcaacagcgtctagcttttatgcaaacctgttggaaaacattccgcctgacattcacacctcgtgtgtggactgaaaggtgaagacttggctggagacacaaatgtgttgctgaaatatgccacaatgtgttctcgttagagttcagagaagactttttggcttgagcccctcgctgatgtcttcttttctcaatgacagcctcccaaatctggcaagaaggtcgcccctgctccgttccctcagagcaaggctggcaagaagggacccaagaaccccctcatcgagaagcgccctcgcaactatggcatcggccaggacatccagcccaagcgaaacctgtctcgcatggtaaagtggcccgagtatgtccgcctccagcgccagcgcaagatccttcgcctgcgtctcaaggtccccccctctctggcccagttccagcacgtccttgaccgcaacactgccgcccaggctttcaagctcctcaacaagtaccgacctgagaccaaggtcgagaagaaggagcgtctcctgaaggaggctaccgccgtcaaggagggcaagaagaaggaggacgtcagcaagaagccctacaccgtcaagtacggtctcaaccacgtcgttggcctgattgagaacaagaaggcttctctcgtcctcatccccaacgatgttgaccccattgagttggttgtcttccttccttctctctgcaagaagatgggcatcccctacgccatcatcaagggcaaggctcgtctcggcactgtcgtccacaagaagaccgctgccgtcctcgccctcactgaggtccgctctgaggaca

SEQ ID NO: 6788 - DNA, 931 bp, Artificial
  Synthetic
aagagaagagctgtgaacagctctggctccgatgatgatgaaaagaatgtgagcagatatctctgcagctctgtctgctagaggaggattacaatgttactccattaccgaagtgacgttactgatgctcccctaggggaccaggctgagtctcttatgagactgtagagtgttatatgtgagcagttcgcaaattttttaagaactaaatcctaaccactcaatgacacagcccgccgctaaaggaaagaaggttgctcccgccccctctgctgccaaggtctccaagaccgaggatgctaagaaccctctctttgagaagaaggccaagtcttacggcattggtcagtccatccagcctaagcgaaacctctcccgattcgtcaagtggcccgagtacgttcgactccagcgacagaagaagattctgagcatgcgactcatggttcctccttctctcgctcagttctccaacaccctggacaagaacaccgctgcccagaccttcaagctcctcaacaagtaccgacccgagactaaggaggagaagaaggagcgactcaccaaggaggccgaggctatcgccgccggcaaggacaagaaggacgtctccgagaagccctacgttgtgaagtacggtctcaaccatgttgtctctctggttgagaacaagaaggccaacctcgtcctcattgccaacgatgtcgaccccatcgagctcgttgtcttcctccctgccctctgccgaaagatgggtgtcccttacgctattgtcaagggtaaggcccgactcggtactcttgtccacaagaagaccgctgccgtcgttgccgtcaccgaagtcaagtccgaggaccaggctactcttgccaccctcgtctccaccatcgaggctaacttcaacgagaagtacgacgagtctcgacgaaag

SEQ ID NO: 6789 - DNA, 593 bp, Artificial
  Synthetic
ataccaacagcaataacgcccaacgaccacacgcccaataatcaccatgcctcccaagtccggtaagaaggccgccccggcccctttccctgccaacaaggctggaaagaaggctcccaagaaccccctcatcgagaagcgcactcgcaacttcggtatcggccaagacatccagcccaagcgcaacctctcgcgcatggtgaagtggcccgagtatgtccgtctccaacgccagcgcaagatcctcaacatgcgcctgaaggttcctccagccattgcccagtttcagcatgtccttgatcgcaacactgccgcccaggctttcaagctccttaacaagtatcgccctgagaccaaggccgagaagaaggaccgtttgacccaggaggccactgccatcaaggatggtaagaagaaggaggacgtcagcaagaaaccattcactgtcaagtacggtcttaaccacgtcgttggcctgatcgagaacaagaaggcggccctcgtcctcatccctaacgatgttgaccccattgagctcgtcattttcctgcccgctctctgccgaaagatgggcgttccattcgccatcatta

SEQ ID NO: 6790 - DNA, 656 bp, Artificial; identical to SEQ ID NO: 5165
  Synthetic

SEQ ID NO: 6791 - DNA, 496 bp, Artificial
  Synthetic
aaaatgtctgattctgaagttatcgctgaagttgaggttgccgccgctgctccctccggaggacttaccctcgaggatgccctcaagaccgtcctgaagaaggctgtcattaacgacggtctcgtccgaggtctgcgagagtgctctaaggccctttctcgacgagaggccgagctctgtgtcctgtgtgactctgtcaccgacgagtcttacctcaagctcgttgaggctctttgcaacgagcccgaggagaagatcccccttgtcaaggtccccgatgccaagcagctcggtgagtgggctggtctctgccagctcgaccgagagggtaacgcccgaaaggtcgtcggtgcttcttgtgtcgtcatcaccaactggggtgaggactccgaggctcgacagttcctcctcgactccattgcttctcagtaaatgcgttgcaatcaaaagcgtaagcaataaaatgccacatggcttatttaaaaaaaacaaaaac

SEQ ID NO: 6792 - DNA, 620 bp, Artificial
  Synthetic
gaaagagaagctcatcagcaagtctggtcctgtttgtctctctgttacacagattcagtgaatcaaggagaagcaccttattctcttcctaatcatggctgctatcgttgaagatgctggagaggtgccctctgcgtcggcgcccactcctgttcttggggagccaatggatcttttgacggctttgcagttggttttgaagaagtctcttgcccatgatgggctctcgcgagggctccatgaatctgcaaaggctattgagaagcatgctgcgcagctctgtgtcctggctgaggattgcaatcaggctgagtatacaaagcttgtccaagccctttgttctgagcacaatgtcagcttgatctcggtccccagtgccaagaaacttggggaatgggctgggctgtgcaagatagaccccgaagggaatgctcgcaaagttgttggatgctcctgtgtcgttgttaaggattatggtgaggagaccgaaggcctgaacattgtccaggagtatgtaaaaagccactgagttgagaagaggaaaagtcaattattaaggaaaaattacactatttttgagcgaaactttactgcaattgatttttcgagtcaatggggta

SEQ ID NO: 6793 - DNA, 395 bp, Artificial
  Synthetic
gcgctggtcaaggaggaggagggaggaagaggaagaagaggaggaggaggagggaggtatctgagcgaggtctaccgccgatcaccatgccttcccacaagacgttcctgataaagaagaagctggcgaagaagcagaagcagaatcgccccatccctcactggattcgtatgaggaccgataacaccatcaggtacaatgctaagcgcagacattggcgcagaaccaagcttggtctgtaagctggattgacagagatgttttgaattcagcatgctgcaatgatggaatggttcattaatttgagaattcctggaattaagcatttaaattttggttcactcagcactgattaaaattttggaaaacaatacatttctttgaatttagctcac

SEQ ID NO: 6794 - DNA, 598 bp, Artificial
  Synthetic
ggagaggagagcgcgagcagccgccatgccgtcgcacaagacgttccggatcaagcagaagctgggcaagaagctgcggcagaaccgacccatcccgcactggattaggatgcggacagacaataccatccgctacaacgcgaagcgcaggcactggcgaaggacaaagctgggtctgtgagttttaagtttgtcatcgaatgggatcgatatttcttttgacagtaatgctcttataagtcgagttgtattcgcatttttgtttgttggttcttttatttttatttttattctttttttcttgcacactcaggcatttggctctttggtaatggatctgttcttagcgtcatgcctgaagaagaaaaaaaaaaaagtgtgtgcgagacagattatttcgtcaccactttgcacagtgcaaaagcctctatttgcacttgtgctttctcagtgacacacaggaacgttttggttgattgggtgccaatgatgtctagtatgcacgtattacctgaaaaatctgtgtgtagtaaattgactctactcctgaggcatccaatttgtgtaacacactatacctaatataaatttttaaaaa

SEQ ID NO: 6795 - DNA, 418 bp, Artificial
  Synthetic
gtctttcagcttcagcagcagcagctccagctcccaggaggaattcccaaccgtgaaaatgccgtcacacaagacattcatgatcaagaagaagctagcaaagaagcagaggcagaacaggcctattccttattggatccgaatgaggactgacaacaccatcaggtacaatgccaagcgcaggcactggaggcgtaccaagttaggattttaaggtggaggatttgagttttgttcaacattttatggaaaactttctggggttttggtattttctacttttgtttactaggagcttcttctgaaatgaaatctagtagagtttctactgatgttttggtaaaagtattggagctcaagtttcagcagagtttatgtattaaatgactatttttggatttattatgttttgttgatc

SEQ ID NO: 6796 - DNA, 406 bp, Artificial
  Synthetic
  misc_feature (394)..(394): The residue at this position can be any nucleotide.
ccgggcttctccgttccaagggtttcctcgggccgccgccgccgccatgccgtcgcacaagacgttccagatcaagaagaagctggcgaagaagatgcgccagaaccgccccatcccgtactggatccgcatgcgcaccgacaacaccatcaggtacaacgcgaagcgcaggcactggcgccgcaccaagctcgggttctgagcttggggaggagaggaggacgaggcgccggacgccgctgccctgggaagaagaagaagaaggagaagctagggcttatgggttgcgtcgtgttcgtttcgaggttttgcctgtcctgaagagactatcagtagctgtgtgtatcttggagcatcataattttgctgattaaagaaccactttcttatcccnaaaaaaaaaaaa

SEQ ID NO: 6797 - DNA, 467 bp, Artificial
  Synthetic
cccacttcacgcacctagggtttcgccgccgccgccgccgcttcttcgtccccgccgcgacgatgccgtcccacaagaccttccgcatcaagaagaagctggcgaagaagatgcgccagaaccgccccatcccgtactggatccgcatgcggaccgacaacaccatcaggtacaacgcgaagcgcaggcactggcgccgcaccaagctcgggttctgagcttggggaggagaggaggacgaggcgccggacgccgctgccctgggaagaagaagaagaaggagaagctagggcttatgggttgcgtcgtgttcgtttcgaggttttgcctgtcctgaagagactatcagtagctgtgtgtatcttggagcatcataattttgctgattaaagaaccactttcttatcctgcctaaagttgtctgaattttatctcagctgcagtggattgatcagttgaactccctt

SEQ ID NO: 6798 - DNA, 548 bp, Artificial
  Synthetic
ggaggagggaggaagaggaagaagaggaggaggaggagggaggtatcttagcgaggtctaccgccgatcaccatgccttcccacaagacgttcctgataaagaagaagctggctaagaagcagaagcagaatcgccccatccctcactggattcgtatgaggaccgataacaccatcaggtacaatgctaagcgcagacattggcgcagaaccaagcttggtctgtaagctggattgacagagatgttttgaattcagcatgctgcaatgatggaatggttcattaatttgagaattcctggaattaagcatttaaattttggttcactcagcactgattaaaattttggaaaacaatacatttctttgaatttagctctcaaatctttcgtgcaatgaacctcttttaagatgattactctggttgcttcattttcctgcctgcccggttgaaaattgtgtgtttactcatctaggttcagatgctctggatactactacatcaagtgtttgttttgactcataatcacaatttaatgtgttctttt

SEQ ID NO: 6799 - DNA, 1244 bp, Artificial
  Synthetic
gggttttgtcgcagctcttgttaccatcgttccagcgcgcacagcgcctttgggctcaccgtcctcgccacccggagtagcggcggcggcggcggcggcggcggcggcggcggcattggatccgccccggcaacggcggcggcggcagcagcagcagtagcaagagaaggaggttcgttttccgcagtagcaaccctggcgcagaagattggcaagtcgattcgagggcctggcgccatgtccaaggcgcgggtctatgccgatgtgaacgttcttcgccccaaagagtactgggactacgaatcgctctcggtcgagtggggcgaccaagaagagtatgaagtgattcgaaaggttggccgaggcaaatacagcgaggtgtttgagggcatcaattgcgtcaacaacgagcactgcatcataaagatcctcaagcctgtcaagaagaagaagataaaacgagagatcaaaattctccagaatctctgcggtgggccaaacattgtcaagcttttggacatcgtcagggaccagcaatcaaagacgcccagcctaatcttcgagtacgtgaataacacagacttcaagacgttgtatccgacgttgacggactacgatattcgctattatctgtacgagctgctcaaggcattggatcactgccactcgcagggaatcatgcacagagacgtgaagcctcacaatgtgatgatcgaccacgagcagcgcaaactgcgtctgatcgactggggcctggcagaattctaccaccctggaaaggagtacaacgttcgcgttgcttcaagatacttcaaaggcccggagctgcttgttgacttgcaggactacgattactccctcgacatgtggagtctgggttgtatgtttgctggaatgatatttcgtaaggaaccattcttttatggtcatgataatcacgatcagctggtgaagattgccaaggtgttgggcacggacgagctgaatgcctatttgaacaaataccacctggagctcgatgctcatttcgagagtatggtcggaagacacagcagaaagccgtggtccaagtttattaacaacgacaaccagcacctggtgaatcctgaggctctggattttctggacaagctgctccgctatgatcaccaagatcgactcactgctagagaggccatggcgcatgcgtacttctatccggtacgtcttgcggaatcaaacagcaggaggagctacctggaaat

SEQ ID NO: 6800 - DNA, 840 bp, Artificial
  Synthetic
  misc_feature (750)..(750): The residue at this position can be any nucleotide.
ggattatgaagcccttactgttcaatggggtgatcaggatgactatgaggttgttaggaaagttggaagaggaaaatatagtgaagtttttgaaggtgtaaatgttaacagcaatgaaaagtgcataatcaagatcctgaaacccgttaagaagaaaaagatcaagagagagataaaaatcttgcagaacctctgtggcggaccaaacgttgtcaaactccttgatatcgtcagagatcagcactcaaaaactccaagcttaatttttgagtttgtgaacagtacagatttcaaagtactgtacccaacattaacggattatgacatccggtactacatatatgagcttctcaaggcactagattattgtcattcacagggaataatgcatagagatgtcaagccccataatgttatgatagaccatgaactgcggaagcttcgcttgatagattggggtcttgctgaattttaccatccagggaaagaatataatgtccgtgttgcttcaagatacttcaagggccctgaacttctagttgacttgcaagactatgactattctttggacatgtggagccttggctgcatgtttgcaggaatgatcttccgcaaggaacctttcttttacggtcatgataatcaggatcagcttgtcaaaattgcaaaggtacttgggacagatgagttgaatgcatatttgcacaagtatcaattagagcttgatcctcagctagaggctatggttgngagacatagtaggaagccgtggtccaaatttattaatgcagacaatcagcatctagtgtcaccagaggctatagattttcttgacaagct

SEQ ID NO: 6801 - DNA, 719 bp, Artificial
  Synthetic
aatccattacccaaatatataacattcccttccctcgtttgatggccgtacggccatttcacttctttgtttcattccgccaccaccacaaccatcgcctcctctctcctttcccggccacctcttctctcttcccctctctcctccgtcagttttcctcgaaaactccgtcgctctctctcacccgactcaaacacaaatcaccttcttcgttacctccgccgtcaccgtcatctccttatcttcatcgaccgtcggcgactttatccgaaaccctggcgcagaaaatagggaaatctattcggcgtcccggtgcgccgtccaaggcccgggtttatacggacatcaatgtgatccgacccaaagagtattgggattatgaatcccttactgttcaatggggagagcaggatgattacgaggtggtaaggaaagtcgggagaggaaagtacagcgaggtttttgagggaattcacactactaataatgacaaatgcatcatcaaaatccttaagcctgtcaagaagaaaaagatcaaacgtgagattaagatactgcagaatctttgtggtggacctaatattgtgaagttactcgatatcgtcagagatcagcaatcgaagaccccaagccttatatttgaatatgtgaataacacagattttaaagtgctgtatcctaatctttccgacttcgatattagatattacatctatgag

SEQ ID NO: 6802 - DNA, 606 bp, Artificial; identical to SEQ ID NO: 5175
  Synthetic

SEQ ID NO: 6803 - DNA, 631 bp, Artificial; identical to SEQ ID NO: 5176
  Synthetic

SEQ ID NO: 6804 - DNA, 627 bp, Artificial
  Synthetic
ggatcaagacacacaatgcgagctttcagatctgccgccaacttcggagctgcttctaacatctaccgaaagtccttcacccccgcttctattgcctctaaccgatttgtctctgccagaatgagctccatcatgaccgacaacgcccgacctaacaccgacaaggttgttcaggacattgccgactacatccatgactacaagatcgactcctccgtcgccatggagactgctcgactctgtttccttgacactctcggctgtggtcttgagggtctcaagtaccagcagtgtgccaacattgttggccccgttgttcccggcaccattgtgcccaacggaaccaaggtccccggtaccgactaccaggttgaccccgtccgaggtgccttcaacattggtaccatcatccgatggctcgatttcaacgactgctggctcgccgccgagtggggacacccctccgataaccttggcggtatccttgccgttgccgactggcagactcgatccgccaaggccggtcttgagggcaaggtcttcaaggtcaaggatgtcctcgagggcatgatcaaggcccacgagattcagggaggtctcgccatcgagaactctttcaaccgagtc

SEQ ID NO: 6805 - DNA, 197 bp, Artificial; identical to SEQ ID NO: 404
  Synthetic

SEQ ID NO: 6806 - DNA, 575 bp, Artificial; identical to SEQ ID NO: 4563
  Synthetic

SEQ ID NO: 6807 - DNA, 487 bp, Artificial
  Synthetic
aattcggcaccaggaaattttgagagtttcccagtggttaacatggagttgcttaacactgaacaaagggctgcaacaatggagaaaattaaggatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaacatctcagaagttcctgatcttgaagatgaatacaggaaaatcatgaaggagtttgctgaaaagctagagaaattagcagagcaacttttggacttgctctgtgaaaatctaagactggagcaaggttacttaaagaaagccttttatggttcaaatggtcctacttttggca

SEQ ID NO: 6808 - DNA, 681 bp, Artificial; identical to SEQ ID NO: 4560
  Synthetic

SEQ ID NO: 6809 - DNA, 956 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgagtctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattggattgatgtcccacctatgaaacactcgattgttatcaaccttggcgaccagctggaggtcataacaaatggaaagtacaagagtattgagcacagagttattgcacaacaagatggcactagaatgtcaattgcttcattttataatccaggaagtgatgctgtgatatttccagcaccagaattggttgaaaaggcagaagaagagaacaagttgaagtatcccaaatttgtgtttgaagattacatgaagctgtatgcaggt

SEQ ID NO: 6810 - DNA, 319 bp, Artificial
  Synthetic
tacgccggggactcacaacagaaatagctactaaacaaacagcaaaagataaccagaaaagatggcgactttccctgttgttgatttggggctgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccacactgagattgatgatctggattgg

SEQ ID NO: 6811 - DNA, 1058 bp, Artificial
  Synthetic
aaaatacatagaaagatggagagtttcccagtggttaacatggagttgcttaacactgaacaaagggctgcaacaatggagaaaattaagaatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaatgtagggaaaatcatgaaggagtttgctgaaaagctagagaaattagctgagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacaccgatgctggtggaatcatccttctattccaagatgacaaagtcagtggtctccaactgctcaaagacgacaaatggatcgacgttccaccaatgcgccactccatcgtcatcaacctcggagaccaacttgaggtgattactaatggaaagtacaagagtgtggagcatagggtgattgctcagcctgatggaaacagaatgtccctagcttcgttctataacccggggagtgatgctgtcatctatccagcaccagaattgttggagaaagagaacaaagtcatttatcctaagtttgtatttgaggactatatgaaattatatgcaggtcttaagttccaggctaaagagccaaggtttgaagcaatgaaggctgtggaaactactgtcaactctgccccaatagctactgtttgagactttgatggagtattaattagaaaactgattaatgagaagaaaatggcttagtattaagattatgatgatgtattgatgat

SEQ ID NO: 6812 - DNA, 681 bp, Artificial; identical to SEQ ID NO: 4565
  Synthetic

SEQ ID NO: 6813 - DNA, 626 bp, Artificial
  Synthetic
gcaataacacggatacctgggactgccctcaccatctttgcattgttgtatgcagttcgaaagaggccctatttgatcacctaagtgagattcacagcattcctaccgacttgaagtgggagggtggcgacaaccaggattcgaccaagcgcaaacgcagctccagtagacgagtatttagaagcaaagctcccgttgactttttgttacagtccacatctcctaccaaggacgccgacagcaataatgctatgaaatggatagctgagccatccaatactcctctatctgaagaagttgcaacaaacgataacaatttgttatccccggcatggggttatgcgaagcctcacaaagacgagataatgattgacccggagttatataataccaagaccgacgacatgccagctgctgagataccagaagttatcgatggcctgaatagccatgaaacacccttggttgatgatgcatatgatgttgattgcatccttgccaaatggaaggaaggccgaagaatgttatatcttgtgaaatggggtgacgaaacaacgacctgggaaccgcatgaagagattctgaaacaagatctaattacagagtttgaaatagggtataaggga

SEQ ID NO: 6814 - DNA, 563 bp, Artificial
  Synthetic
gactcatctatcggaggagctgtcaccatgagtaaacgtgacaagcgcagctccgtcgcggaccgaagcgttctctggacctcgcagatgcaatctctttacaagacggtggaagggtcgcaaaagtttcttccaaacgcgattgggcgtcatgtggttctcaatgctgggccttggatcgaattggacaatgcaacgtataagagcagaagggccatgcaaatatttctgctgaacgaccatctccttatcgcctctcgaaagaaacgcaaggtggatgcacccaacgcagatacccgtggacccatggtaaagctcgtcgcggaccgttgttggcccctgctcgacatcgaagtcattgaaatgccagggacaggcgattccattggcggccgtaccaagttggccgacgccatcatggttcggggtggtggccaagagacgttcatctaccgcacggaaaagccagaagcgagcgagaagaaggcattgatgatgaacgtgcgcaaagcagtggaagagctacgcaaaggtttgcagtctgagatggaggccaataacaa

SEQ ID NO: 6815 - DNA, 619 bp, Artificial
  Synthetic
gaattcagagactgatcctctctcgcacatggcagtcaaatcaagatgtttactgcaaggagaaagatttcgaaggacaaaggtgctgaaccaactgaattcgaggagtcagttgctcagtcgctctttgatttggagaacactaacaatgagctcaaaagtgatttgaaagatctatacattaattcagctgttcaagttgatgtgtctggcaaaaaggcagtcgtcatccatgttccctacagactacgaaaaggtttcaagaaaattcatgtgaggcttgtgagagagctcgaaaagaagttcagtggaaaggatgtgattcttattgctaccaggagaatagtgaggccccccaagaagggtgctgcagttcaaagaccccgcagcagaactcttaccgctgtacatgatgccatgctggaggatgttgtttatcccgctgagattgttggaaagcgcatcaagtaccgtcttgatggatcaagaatcatcaagatcttcttggaccctaaggagaggaacaacaccgagtacaaattggagactttcagcggagtttacaggaagctctctgggaaagatgttgtgttcgagtacccaataacagatgcttaaa

SEQ ID NO: 6816 - DNA, 777 bp, Artificial
  Synthetic
tctttcgtcgctgcggcgcgtcttctctcgatctccaggtgatagagggccgccgtcatgtctgcgcgcaagaagatccagaaggaggaggggaaagagccggattctttcgagctcacggttgcccaggctctgtctgagctggagggcgcaaaccaggagcttcgaggagacctgcgcgacctctcgatcaattcggcgatggaggttgacgtctctagcaaccgcaaggccgtcgtgatcaacgtaccgtaccgcttaagaaaggcgtaccagaagattcaacccagactggtgcgagagcttgagaagaaattcagcggcaaggacgtgatcttgatcgcaaccaggcgcatcctgaggcccccgaagaagggcgccgccgtgtctagaccgaggagccgaactctcaccgctgtgcacgacgccatccttgaggacctggtctaccccactgagatcgtcggcaagcgcatccggtaccgcttggatggctccagaattctgaaggtttaccttgacccgaaggaacgcaacagcaccgagtacaaggtggagacgtactcgggcgtctacaagaagctgactggcaaggatgtggtgtttgagtttcccgtgcaagaaacggcctagactcgtaatggagcatttcccttttttttgctctgatgagtggcttaagcgctaaaaattttgacttttggttcttaagtggggtttccagtttcgggccggtttgacggcttctcgaatacatggttttccattatgggcgtc

SEQ ID NO: 6817 - DNA, 902 bp, Artificial
  Synthetic
tggtatcaacgcagagtggccattacggccggggggatcttctgtcagagcaagtgattccggcacactcacagatctgtccgctgttgccgaacactcagagatctgtgaagatgtatacatcaaggcaaaagattcacaaagacaaagatgctgaaccttctgaatttgaggagtccgttgcacaggctttgtttgacttggaaaacaccaaccaagagctgaaaagtgaattgaaggatctatacattaattcagcagctcaaattgatgtgtcaggaaataggaaagctgttgttattcacgtaccgtacagactgagaaaagctttccgcaaggttcatgtccgtcttgttagggagctggagaagaaattcagtggaaaggatgtaatcttcattgccaccaggaggatagtgagaccccctaagagaggctctgctgcccagaggccccgcagcaggactcttacttctgttcacgatgctatattggaggacttggttgtaccagctgagattgttgggaagcgaactagatatcgcattgatggatccaagataatgaaggtcttcttggacccgaaggagcgcaacaacaccgagtacaagctggagaccttttctgcagtttacaggaagctttcaggcaaagatgttgtgttcgagtaccccatcacggaggcttaaaacaagatgttgtgttcgagtaccccatcatggaatcttaaaacatacaaaatagtgctcttgatctctttgatgcagaactataattagtggctacttcataaaattttggcatttaaattttgtttggaaggcagaggactgttaaaactgtttttgagtttctatggaattttgttgcaatctactagaaagataatcaacttgttttat

SEQ ID NO: 6818 - DNA, 761 bp, Artificial
  Synthetic
cacacacacacacaccagctctgtagttgcctcttacccgcagatctgtgaagatgtacacgtcaaagcaaaagattcacaaagataaagatgctgaacctactgagtttgaggagtctgttgcacaggctttgtttgatttggaaaacaccaatcaagagctgaaaagtgaattgaaggacctatacatcaattcagcagctcaaattgatgtgtcaggaaacaggaaagctgttgttatccatgtgccctacagactgaggaaagctttccgcaaggttcatgttcgccttgttagggagttggagaagaaattcagtggcaaggatgtaatttttatcgccactcggaggatagctagacctcccaagagaggttcagctgctcaacgaccccgcagcagaactcttacttctgttcatgatgccatattggaggacttggttgttcctgctgagatagttgggaagcgcactaggtatcgcattgatggctccaagataatgaaggtgttcttggaccccaaggaacgcaacaacaccgagtacaagttggagattttttcagccgtttacagaaagctttcaggcaaagatgttgtgttcgagtaccccatcactgaggcataaggaaacaaaatgcttatcttcatcaatttgatgtgaaactacagtttagtggttcctttgaaattttgacaatttcattttgtttagaatgcagagaaccatgtgaagtttctattgattttcacttataac

SEQ ID NO: 6819 - DNA, 644 bp, Artificial
  Synthetic
ctcaaactaaacgtagctagggtttcccgccggcgctgttccttgcctttctctcacagatctgtgaagatgtacacgtccaggcaaaagattcacaaagataaggatgctgaacctactgaatttgaggagtttgttgcacaggccttgtttgctatggaaaacaccaaccaagagctgaagagcgaattgaaggacctatacatcaattcagccatgcaaattgatgtgtctggaaacaagaaggccgttgttctccatgtcccctacaggctgagaaaagctttccgcaagatccatgtccgccttgttagggagctcgagaagaaattcagtgggaaggatgtaatcttcattgccacccggagaatagcgagacctccaaagagaggttctgctgctcaacggccccgtagcaggactcttacttctgttcatgatgccatattggaggatgtggttgtacctgctgagattgttgggaagcgtgttaggtatcacgttgatggatccaagataatgaaggtattcttggacccaaaggaacgaaacaacaccgagtacaagctggagactttttcagctgtttacaggaagctatcgggcaaagatgttttgtttgagtaccccatcactgaggctta

SEQ ID NO: 6820 - DNA, 582 bp, Artificial
  Synthetic
cgggaggtgaaggagcgcactgcgaagcgaacccttctccgccgcctccgctcttcgctgcacggtgctagctcgccgccgtccgtctcgcgcgcctcaagggttatcacaagatgtatacagcaaggaggaagatccagaaggacaagggtctggagccaactgagtttgaggacactgttgctcaggcattttttgaccttgagaatgggaatcaggagctgaagagtgacttgaaggacctttacatcaatggagcagttcagatggatttacctggcaacaggaaggctgttattattcatgttccatacaggctgcggaaggcatataagaagatccatgtgaggcttgttagggaacttgagaagaaattcagtgggaaggatgtggttctggttgcaactagaagaatagtgaggcccccaaagaaaggctcagctgttgttcgccctcgtacccgcacacttactgctgttcatgatggcatcttggaggatgttgtgtatccagcagagattgttgggaagcgtgtcagataccacttggatggtagaaaaatcatgaagatcttcctggacc

SEQ ID NO: 6821 - DNA, 869 bp, Artificial
  Synthetic
agctttctcttcggccagagaagatgtttaccgcgattaggaagatccagaaggaggctgggcaggagcctgatgagttcgaggagactgtcgctcaggcattgtttgacctcgagaactccaaccaggagatcaaaagcgatctgaaggatttgttcatcaactctgccaagcaagttgacatatctggaagcaggaaggctgttgttatccacgtgccatacaggctccgcaaagcatacaagaaaatccaccctagactagttcgggaacttgagaagaagttcagtggaaaggatgttgttttgattgccacccggcggattctaaggcctcctaagaagggttctgcagccactcgcccacgaagccgaacccttacttctgttcatgaagccattcttgacgacttagtctaccctgctgaggttgttgggaaacgtatccggttccgccttgatggctctcgaatcatgcgggtgtacctagatcccaaggagagaaacagcacggaagcaaagctcgagacattttcagcagtttacaaacgtctcaccggaaaagaagttgtcttcgagtaccctgtccaagaaactgcttgaggcacccttcttgcacatttttgaatgtgaggtagttgagctagataactttgaatggcatctttccctaattttgccatcaatttatgatgatgagtcatcatcatcctcttttcaacatgcattttatagatgttcaaaatcctacttaatatttactcggcaatatttttcttaatgatccatcgaactgttctttagttagtgtgcctaatgttattgttgctaccaagtttcttctcaatatatcaaagagttcgtttggga

SEQ ID NO: 6822 - DNA, 659 bp, Artificial
  Synthetic
ccacgcgtcgggccaattgggcgtccccgccatggagcgccacaagcaggccgtcaccaaaatcgccgccgccgtccgcggctactttgagcgcggcgagtcctaccgcatcttccacggctcgacaaacagcacgcggcctcgccccggccccggccaccgagccgtcgacatcagcgccctcagcaacgtcctggccgttgatcgaggcgcgctttcggcgcttgtcgagcccaatgttcccatggaccgcctggtcgaggcgacgctccgccatggcctggtgccgcctgtggtgatggagtttcctggcatcacggccggaggcggctttgcgggcacggcgggcgagagcagctcgttccgccacggcttcttcgacgagacgatcaattatgtagagatggtgctaggcaatggcgaagtcgtgcaggcttcgcccaccgagagggcagatctgttccgcggcgctgctggagctgtgggcacgctgggtgttacaactctgatggagctcaacttgatcgaggctcgcaagttcgtccaaactacatatcaccgcacaaacagcgtagccgaagcagcagaacgtgtccgcgtagagacgcaaaaccccagcaacgactacgtcgacggcatcctcttctccaaggaccacg

SEQ ID NO: 6823 - DNA, 286 bp, Artificial
  Synthetic
actggcgggaggcgtgctgacctgatcggacgggacgtgttcgaggacgatgcgccaacgcatttgatggcaacgggtgatcccgagggcgaaagaaggaggcgtgagagtgtgtaactggtgatgatgagatgggatgagatgagctgggaatctgtccttggacatctttgctgactttatgagttggatggctggcactctctttcggcgcagagacaccagacacgtagatatacagcgccgtggtcggtatacgggtacttgcagcgcagagagtagagcg

SEQ ID NO: 6824 - DNA, 203 bp, Artificial; identical to SEQ ID NO: 598
  Synthetic

SEQ ID NO: 6825 - DNA, 709 bp, Artificial
  Synthetic
ccacgcgtcgcccacgcgtccgcagcatccaacagcatctccaaacctctactccttaatctccaatcctctagtcttcaagacaaaccccaaaaactccattcaaaatgaagttcttcactgttgccaccgtcttctttaccgctgtcctcgctgccccaggcggctactaccctcctcctcctcctcctacctataccctgcctcccaatggcaacggcaacggcaacggcaacggcaacggcaatggcaatggcaacaccaacactggcggttctgccctgtgcccttctggcctctactccaaccccaattgctgcgccaccgatgtcctcggcctcgctgatctcgactgcagcgttccttccacaactccacacgatggcgctgctttccgaagcatctgtgcggcgactggcaagagagctcgctgctgtgttctccccgttgctggcgtagctgttctttgccaggaccccattggcgccaattaaaaggcatcgccaatatgactcacgaggtcctttgatgaatgtgttattgcacatggctcggacctacggtatcaacactgaacactgacttgaacatatgagtcgtgagcttttggatatatggaatatgacggttacttatcttctatctaagttggatatagatttgtatacacatgacgtacttaggcatagtgtacctgataatcaactac

SEQ ID NO: 6826 - DNA, 570 bp, Artificial
  Synthetic
aacccgctctttcaattcactcgctaagtgcagcttcacttcaaattcactccttttataatactttccctcgttgtatacaaacaaacaaacatcagtcaagatgcagttcttcgccgttgccgctcttctcttcaccgcagctttcgctgctccctccaccgaggcccccgcggaactcgctcgccgtaacgaagcctggtgccccaggggactgtacgcggtccctcagtgctgtgataccgatgtcgttggtgtcgctgatctcgattgcgtcgtcccccctttcgcgcccagcaaatgcaagtcgttccatggtgcctgtgcttccatcggccgtcaacccaagtgctgcgtcctccccgtcgctggcctggctgttctctgcaccgatgcccttcctcccgctttttaaacgcacatttaccaactcctcccggccgagagtcgggtcaatatctgggacaggctttgtacattgagctttctgttcgtgacgtgttaataattctatgtcggctctggataaaggacggatggagaatggaggctcgggttaaagggataaac

SEQ ID NO: 6827 - DNA, 269 bp, Artificial
  Synthetic
tcaacatccggccttttttgggggtttctcttgtgcgcgccgtcgtattcgtcagatgtcactgcagctgcgggtttctcgggggtttcgcacggttgttttatcaactcgtggtcacaaggacgatgtcaatctcttcagctttactgctggagaggcacagacgcacgaatgactctctcatcggaagaacgaagaaagtgcacaccaaacctataatatctagtgttgatctttttttatttccaaagacacctctcgtttatatg

SEQ ID NO: 6828 - DNA, 690 bp, Artificial; identical to SEQ ID NO: 4505
  Synthetic

SEQ ID NO: 6829 - DNA, 570 bp, Artificial; identical to SEQ ID NO: 4509
  Synthetic

SEQ ID NO: 6830 - DNA, 679 bp, Artificial
  Synthetic
cccacgcgtccgcccacgcgtccgcccacgcgtccgcccacgcgtccggctcagcatctctaggcttcagcactgcaatcttcgtctttctgcaaactcaattaatcccctctaccactctgccaccttcagatttgagcttgggtttgaaggtaaggaagtaacatatggcgtcaaagcgcatattgaaggagctgaaggatctgcagaaggaccctcccacatcatgcagcgctggtcctgtggctgaggacatgttccattggcaagcaacaatcatggggcctacagatagcccttatgcagggggtgtattcttggtttctattcattttcctcctgattatccgttcaagccacctaaggttgcatttcgaactaaggttttccaccctaacatcaatagcaatggaagcatttgtctggatattcttaaagagcagtggagtccagcattgaccatatctaaggtcctgttgtccatctgctctctattgacagacccaaatccagacgatcctcttgtaccagaaattgctcatatgtacaagactgacaggtccaaatatgaggccactgctcgtagctggacacagaaatatgccatgggataatagcaaaagtgtcaccgggcatgtcagagactttgtagctgcaccgtcttaattgtgcttgggtg

SEQ ID NO: 6831 - DNA, 653 bp, Artificial
  Synthetic
tctttctctcctatctctctcctctctctctctcatggcttccaaaaggattcagaaggagctgaaagacttgcagaaggacccccccacatcatgcagtgcaggtcctgttgcggaagatatgtttcactggcaggcaacaattatgggaccagatgacagtccttatagtggtggtgtgtttttggtgacgattcatttccccccagattatcccttcaagccccccaaggttgcttttaggaccaaggttttccacccaaacatcaacagcaatgggagcatttgcctggatatattaaaagagcaatggagtccagctctgacaatatctaaggtcttgctttcaatctgctcacttctcactgatccaaaccccgatgatcctctggtacctgagattgcacacatgtacaagatagacagagcaaaatatgaaggtattgcaaggagttggacacagaagtatgcaatgggttgagccttttttttcggcaaaagataacaacttttatcagtctatctcatatctaaaaagaatcggtttacaactttctgtttctgcatcttgttggtccaaagctcaaatcacacgtgtatctttactttcatagccaaggagttgatatagaagtagtgcaaggaacaggtac

SEQ ID NO: 6832 - DNA, 716 bp, Artificial; identical to SEQ ID NO: 4547
  Synthetic

SEQ ID NO: 6833 - DNA, 794 bp, Artificial
  Synthetic
cccacgcgtccgcgcacggtgatattgagaatcgccgacctgaatcgatcggaaaactttctctgattaccggcggtcaacaccgctgaacacatatgtttgtttgacgacctcttctctccgcgatctttacctcaacaacgagatctgtttccacgaaagaaaggaggatgtcgacgccagcaaggaagaggttaatgagggatttcaagaggttgcagcaagacccacctgcgggtattagtggtgctccacaggacaacaacattatgctctggaatgctgtcatatttgggcctgatgacacaccatgggatggaggtactttcaaactctcactgcagttctctgaagattatcccaataaaccaccaacagttcggtttgtgtcacggatgtttcatcctaatatttatgcagatgggagtatctgcttggacattctacaaaaccagtggagtccaatctatgatgttgctgctatacttacctccatccagtccttgctctgtgaccctaatccgaattctcctgcaaactcggaagctgctcggatgtacagcgaaagcaagcgcgagtacaacaggagagtgcgtgatgttgttgagcaaagctggactgctgactagtagtagtttgttgtaagcgttgtagctctctctactttctctcaatcacgattcagcaacagctttcttctcttttcattcatgtcttgtgtttccaaaactatttaagtgattccatgctttgatgtaacccaacatccttaaaaaaacaactttgttccacac

SEQ ID NO: 6834 - DNA, 471 bp, Artificial
  Synthetic
cccacgcgtccgctttaccctttcgagaaaaaagaaaagaaaaaagaacttgttttcctcttcagcaagacacataaatcgtaatccattttctctcaactttaggaatctcaaatctccgatttggaaatccggcgacaatggtgagagatattgaagatgagattagagacgagaagaatcctcgtcctcttgatgaagatgatatcgctctcctcaagacttatgggttagggccttactctgcacctatcaagaaagtggagaaagaaattaaggatctcgccaagaagatcaacgatctatgtggtatcaaggagtctgatactggtttagctcctcccagtcaatgggatcttgtatctgataagcaaatgatgcaagaagagcaacctctgcaggttgcgagatgcacaaagattataagtccaaacactgaagacgccaaatacgtcataaatgtcaaacaaa

SEQ ID NO: 6835 - DNA, 61 bp, Artificial; identical to SEQ ID NO: 5125
  Synthetic

SEQ ID NO: 6836 - DNA, 117 bp, Artificial; identical to SEQ ID NO: 5218
  Synthetic

SEQ ID NO: 6837 - DNA, 235 bp, Artificial
  Synthetic
gctggcaacacccctgctctgcgaaagtccgagattgagtactacgccatgctcgccaagtgcaccgtccaccacttccagggcggcaacaacgagctcggtacctcttgtggtcgactcttccgagttggcgccgtcaccatcatggatgccggtgactccgacattctgactgctgagctttcttaagcagtttgaagacccccaaaataaaaattaatgtactttagtgccg

SEQ ID NO: 6838 - DNA, 1063 bp, Artificial
  Synthetic
agggggtgatattggaatacctagggacgcctctcaaaccggcctgttccatgaaggaaaccctgcagcagcgccgttagactgacctgacttgacgaaagcaccggtcgagacaggatgaatttgcgcagccgggcatcgcagccgcacccgcagcgcatcgcatcgcatcgcatcgcatcgcagcgcatccaagacaaggccggtccgggtccggcccagccagctgctttttttcatcatcttctttttgtttcggcgcccctcatgatatcagtccagtgacgctagagcaggtgtcacatggccgatgacaacaacgtggtggtgcagctaagctccggctagctgttatctggcgacggaatgtgtgtgatgccattgggtggtgttgcgaatggctgctggttcgcgcgggctcacactcacaccatccatcaccaacagcccaatgacctgttcaacgtcccttgccccatacggtactgtacatacatgtactcgtgcagtccagtccagacaatctcgctgacggaggggcgcgccacaagtggaatcaatggagtgatccaatgtgaaggcatttctgtcttcttggacaggcagggggtagcagtacctgcacgcactgcagcgcattttagcgccgctccgtacttgtacatgagaagggggtccagcgcgccacttttgtgcagccaagtgccatctcggtacttgattgcgagaggctacttttggttggttccctgccagcccagcgtcgtgcgaaatgtgctccatccccatcccatacgcaatgttgccgcatcgcaagcaaccctcatcgcctgtcctggtgcgttttcagcaggtagtactccgtagttgcactgtaacggtacggtagggaggagccgcgggaggaggagcatcgtgatgttcccctcgctgcgtcgaaagaggcaaacagggccagagtgaatcgagatggcccttcgtcccacactgccggacgcgtgggcggacgcgtgggcggacgcgtgggcggacgcgtgggcggacgcgtgggcggacgcgtggg

SEQ ID NO: 6839 - DNA, 841 bp, Artificial
  Synthetic
  misc_feature (796)..(796): The residue at this position can be any nucleotide.
cccacgcgtccggtcggatcctccattgcttcagcgatcacaccgatgctggagtgtcaacgacaaagcagagagagggtttaatgggcaaaaccgaaaatctataattcttcaaatttctggattttgatttaagtggtatttcagattggggatcgtatattgaaatttcgagtggttgattgggtttacaggaggatggtgctggtattagcattgggcgatcttcacatcccgcatagggctgctgatcttccagctaagtttaagtctatgcttgttcctggaaagatccaacatatcatctgtactggtaacctatgcattaaagaggttcatgattacttaaagactctttgtcctgacttgcatattgctagaggcgagtatgatgaggagacacgttaccccgagaccaagacgctaacaattggtcaatttaagcttggattatgccatggccaccaggttattccatggggtgatttggactcattagccatgcttcaaaggcaattggatgtagacatacttgtgactggccatacccatcagttcacagcctacaaacatgaagcaggggttgttataaatccaggatctgctactggtgcctacagtagcatcacatatgatgttaaccctagctttgttctaatggacattgatgccctgcgtgttgtggtctatgtttatgaactcatcgatggagaagtcaaagttgacaagattgatttcaagaagacaacaacacagaatgctaattgaatagcataacttgaaattcagctgattntagtggaatcctgaagtcgataagacattatattcctctgtctgc

SEQ ID NO: 6840 - DNA, 611 bp, Artificial
  Synthetic
ggagtaaaggaggatctgaggaggtcgaaacgatgctttgattcagttgaagggcattgaaatgtgcagtatccagcctgagggtgtacacttgtgcacttattgtagatgttgctaagttgattcccaagaaaaacagagtggaggtgtacagatacctcttcaaagagggagtgctgtatgcaagaaaagattttaatcttccgaagcacccagaaatagatgtgcccaatcttcaagttatcaagttgatgcagagcttcaagtcaaaggaatatgtgaaggagaactttgcatggatgcactactactggtatttgacaaatgatgggattgagtacctcaggacgtacttaaacttgccatctgagattgttccagacactttgaagaagtcagcaaggcctccgggtcgccccatgggtggcccccctggaggggaccgtcctagaggaccacctcgttttgacggagacaggccaaggtttggtgatcgtgatgggtatcgtggtggtcctcctcgtgactctgctggatttggtgacaagggaggtgcaccagatagttttcaaccatccttccggagtcgtcctggctttggtcgtggcggt

SEQ ID NO: 6841 - DNA, 769 bp, Artificial
  Synthetic
cggacggtgggctgcaatcgtctgaggcttcagagtgatttctctcagttatccgctctcttcttgcagcagccatgattatttcagagaaaaaccgtagagagatctccaaatacctcttccaagagggagtatgctatgccaagaaggactacaacttggcgaagcatccattgatcgatgtgccgaacctccaggtgattaagcttatgcagagcttcaaatctaaggagtacgtccgcgagacgttcgcctggatgcactactattggtaccttaccaatgatggtattgagttcctcaggacttacttgaaccttccttctgaaattgttcctgctactttgaaaaaatctgctaagcctcttggtcgtcccatgggtggacctcctggcgatcgtcctcgtggaccaccaaggttcgagggtgataggccaaggtttggtgatagggaaggctatcgtgctggaccaagaggtccacctggtgagtttggaggtgaaaaagggggagctccagctgactatcagcctgctttcaggggttctggtggaagacctggatttggtcgtggatctggaggttttggtggtgcaccccctagttcaagcttctcttaagtccttgctatcttaggctaggtggttgcaattttgattatcagatggaaacacttggttgttcattttcttgtcaaacttaaaattccaagctgggaaagtttatctttatgggtttttagagaactataagttttacttctgtttct

SEQ ID NO: 6842 - DNA, 741 bp, Artificial
  Synthetic
cccccagtccgtccctttgctgctgcatttgggtggaggcttcagttgatttcccacttctcctcaattttcgagcagctatgattatcccagagaagaaccggagagagatctccaagtacctcttccaagagggagtatgctttgcaaagaaagactacaacctggcaaagcatccgaatatcgatgtgccaaacctacaggtgataaaattgatgcagagcttcaagtcgaaggaatacgtgcgtgagacttttgcttggatgcactactattggtatctgaccaatgatggcattgagttcctcaggacttacctcaatcttccttccgaaattgtccctgctactctcaaaaagtccgctaagcctcttggtcgtcccatgggtggccctcctggcgaccgtccccgtggaccatctaggtttgagggagataggccaaggtttggtgacagggaaggttatcgtgctggtccaagaggtccacccggtgagtttggaggtgagaagggtggagctccagctgactaccagcctgcattcaggggtggtggtggaatacctggattcgggcgtggggcaggaggtttcggtggtgcaccccctagctcaagcttctcatagattgatcatatctttattgtagctagtttttatgcatttttgataatcacatgttggaattaacttgcagcggtcgaaagcacttggttcaattgggcataaacttctttattgg

SEQ ID NO: 6843 - DNA, 676 bp, Artificial
  Synthetic
attgtttcttcgctcgctttccggagtaccacgaggatctcagcgaaggagcgatgttgattcccaagaaaaacagggttgaggtgtacaggtacctcttcaaagagggggtgctatatgccagaaaagatttcaaccttcccaaacaccctgaaatagatgtgcccaaccttcaagtgatcaagctgatgcagagcttcaaatcaaaggagtatgtgaaggagaacttcgcgtggatgcattactattggtatctcacgaatgatggtattgaatacctcaggcagtatctcaacttgccttcggagattgttccggatacattgaaaaagtcggcacgacctcctggtcgtcccatgggtggccctcctggagatcgtcctaggggacctcctcgtgatggtgacaggccaagatttggtgaccgggaaggttaccgtggtggtcccccacgtggacctggaggattcggtgacaacaaaggaggtgcacctgatagcttccaaccatcattccggagtcgccctggattcggacgaggggctggtggctttgggagtggcggtgaaagcggccctgcttaagcttcttctctgagtaaaataaccatcggttagctactcaatagcacttggggtacccgacatgtcttgcaattgtgctcctttatcaattt

SEQ ID NO: 6844 - DNA, 550 bp, Artificial
  Synthetic
aaatgttgattcccaaggaagaccgaaagaagatccaccagtaccttttccagcgtgagtagagagcgagcgggatttcgaaattacacgaccgatatggaggacatgactgacgacttgtggatggatgggacgacctttgatttgctgtgaacagacagcatacgacgacgcataatgcaacgaccaatctgtggtaaaagggaggagcgatcaaagtgaaggaagcccgaatcagtcacagtcgctgtcagaaacaccctccatcaatgaacatgtggatggttccgtcttgcaacacttttttgcaattcaagcagaaacaagttactaaccatcagagggcgtctgtgtcgctaagaaggactttaaccagcccaagcacgaggacattgacaccaagaacctttacgtcatcaaggctctccagtctctgacctctaagggcttcgtcaagacccagttctcttggcagtactactactacaccctcaccgacgagggtgttgagtacctccgagagtacctccaccttcccgagggtgttgtt

SEQ ID NO: 6845 - DNA, 651 bp, Artificial
  Synthetic
gggttcttgattggccggccctagtacagcggcagcttgggaagaggctggaggcgacgccgcgaagatgttgatctccaagaagaatcgcgtggaggtctacaagtatctgttcaaagagggtgtgctctatgccaagaaggactacaacctgcccaagcacccggagatcgatgtgcccaatctccaggtgatcaagctgatgcagagcttcaagtccaaggagtacgtcaaggagtcgttcgcctggatgtactactactggtacctgaccaacgatggcatcgagtacctgaggaccttcttgaacctcccgtccgagattgtccccgccacgctcaagaagtcggccaggccaccgggccgtcccatgccccagcagcctccaagaggtcctccacgatacgagggggacaggccgaggttcggggaccgcgagggatacaggagcggccctcgagggggtggattcggggacaagggtggagttccaccagaattccaaccttcgttcaggggtccaagaactggatttggacgtggtggcggcggctttggaggccccagtgctcccggcgctctcaccgagtagagagtttgtttttgttgtggatcactcgcatgctctaatgctaaatttgatgtgaactt

SEQ ID NO: 6846 - DNA, 768 bp, Artificial; identical to SEQ ID NO: 5225
  Synthetic

SEQ ID NO: 6847 - DNA, 92 bp, Artificial; identical to SEQ ID NO: 5229
  Synthetic

SEQ ID NO: 6848 - DNA, 676 bp, Artificial
  Synthetic
gaatcacttatatgaagcacttgtcgggacctggtttgaactcttccctcttcttgattcacctctccccctacacaacactcttcttgctcttcccaagccttactctccttggatgagcaacgtgctgccctccctttactgtctgctccagcctttgagccccatcgttgcgtgcacctgagacgacgaaacgccgtcatcagcgcccctcttagtgtgctgcactaccactaccacttttctgccgacgcatcatcgtcgactgggcacgttcgctgcatctcgaggaaccaccgtcacgattcctcccataacaagaaaacgaaaggctgctgaggcgacgatcacatccaccgactctgaaaacactccccagaagaagatcgtcgcctcagctagtctcgccgctgctcctcccacgcccgtcactacccgcgagatggattccgaggaagagtatctgtcaagctctgatgagttgatgccagacgatagcggcgatgaaatgtctggtgctgaagattttgacgaagatgacttcgacgaaccagatcccgatttcggcctttccgcgaaagatctcgacaagaagaaggtagccgctcacgcggtctccttcaaagtcttcgagccgtccgacattagacgccaacaggatgacatgatgaatgat

SEQ ID NO: 6849 - DNA, 646 bp, Artificial
  Synthetic
gggcttgggagatgaaaaggggcttcttttttatgtagagtagagtaaatacgttttgagttggtcggcggctacatgtggattccgggcaaagttgccagagcgatcagttcgacgataatcaggttggtgctaaaatcacccgctagcagggaaaagcatgaaactagcaggattgaagcaagagaaccgaggactcgaggcttcacccgagaactcaccgtgctgtacgggaattaacggcagcaagaagacggaaaaataaaaaatggaaaaggaaaaaaaactgttgtgggatccagtgttccaagattgttgagacgggaaatgttgtcaatgttgcaaaaagccagggtctgccacatcccgtgctcgaggcgccatctaggattcgcagatcacatccactatggagcatatcaaggtagcattagagcatctctaacactgaatctcgatggatgacacatgaaagaaaagataaaaacaagaaaacttttcaaataatggggacttcttgatgtggcatcagctttcgaggcggtgggcgattcagcttgtgatttcccttatctcttgcgctactgtattatgcctcaagacttttcggtcttttggtttggtttttattctcgtgccccccctt

SEQ ID NO: 6850 - DNA, 476 bp, Artificial
  Synthetic
ggatcacaagacaaagccctcgacgccgaataatccgcatctatacattgcgcacatattcccaacatgccgaactcgtgccaggaactccgcgatgccctcgcgcaatgcctccaggaatccgactgcgtcatgatctaccgcaacaaggcctccgactgcctccgcgagcccctgtcgtcgaccctcccgaccaagtgccagcagctcaagaagggctacggcgagtgcaagcgcggcctggtcgacatgcggaagcgttttcgagggaacatgcccgtgacgtatcgctcggtggaggcttcggagcagggtaaaggataccagctttacgcgggcaggtctgcgtttggaggcggcgtcaaggagacggacggcaatgagccgattgagcaggactggagggaggctgacaatgaaaagtaccggttggagcagcagaggctggctcagagcgggaaataaagaaacggatg

SEQ ID NO: 6851 - DNA, 627 bp, Artificial
  Synthetic
ttgtgagcgagattatgggccgcgaatctgccgcattcatcggggcgatcgaccagggcaccacaagcactcgatttatcctctacgatcgcgatgcgaaggccgtcgcgtcgcatcagctggagtttgcgcagatttatccccaggccggatgggtggagcatgatcccatggaaatcctcaagaccgtgaaggtttgcatggaagaagcttgcggcaagtttgcaagcaagggtgtaaacttcgatgtggaagccatcgggataacgaaccagcgcgagacaaccattgtgtggagcaagagcactggcaagcctctctacaatgccattgtttggatggatactagaacaagctccatttgcaaacgcttggaacaaagtctctctggtggaaacaagcacttcgttgagaactgtggacttccaataagcacgtacttcagcgctttgaagctactgtggctgctggagacagtccccgacgtgaagtccgccgtgctctccggcgacgctctcttcggcacagtcgatagctggctcatctggaacatgaccggcggcatctccggcggtcttcacgtcacggactgctccaacgctgctagaaccatgctcatggacctca

SEQ ID NO: 6852 - DNA, 582 bp, Artificial
  Synthetic
agggagcgtcaaggatccaattccccgttatcgagtacaaatccggagcatgtcttgctggaagctgagtcttcctcctctgtctgttctttctccattctgtgtcactgttggctgctctgtgattgcctatccatagcggtcggatattgtctcgtacttcatcacgaccgtcacttacatcacctggtatcaccaaccatcactccctttgtttcatccactccatcatcatcatggcgcccactggacccatcaccacccccatcaccaccctgttgggcatccagcatcccatcctcctcgccggtatggcgcgcacttctggaggtcgtcttgctgcagcagtgtccaacgcgggcggcctcggtgtcattggcgggttccagtacacgcccgaacagcttcgcgagatcattgccgagatgaaggcaaacttcaagagcccggacatgccatttggtgtcgatttggcgctgccacaaattggaggcaacgcgcgtaagacgaatcacgactacacaaggcggcaagctggacgagctgattgacatcaccatcgacagtggcgccaagctgttc

SEQ ID NO: 6853 - DNA, 287 bp, Artificial
  Synthetic
ggctaagggagaggctccgcccgtttgagctggacatttcgtcgagctaatggatgatacaagttggtttttagttggtaacgatccaagcttagggcccccatctggcgggaggaaaatctgatatgtaatgggaatgactttgcactatggctctggtggtacatgataagatgagatgggtgtaagaagagaaaaggaagaaggagaagaaacgactaagacagtgagagaaattgccacatccaatactccctctgtaaggtttttttaacaaaaaaaaaaaa

SEQ ID NO: 6854 - DNA, 256 bp, Artificial; identical to SEQ ID NO: 5234
  Synthetic

SEQ ID NO: 6855 - DNA, 694 bp, Artificial
  Synthetic
cccacgcgtccgcaagtattccttacaatggcttccgtcacccgtctcagcaactctgccctgagggcttcattgcgagcccctgcccgggccacggctttcaatgccacccgctgctactccgccaaggctcagtccctcaaggaccgctttgccgagcttctccccgagaagattgagcagatcaagactctccgaaaggagcacggttccaaggtcgtcgacaaggtcaccctcgaccaggtctatggcggtgcccgtggtatcaagtccctcgtctgggagggttccgttctcgacgccgaggagggtatccgattccgtggaaagaccatccctgagtgccaggagatcctccctaaggctcccggtggcaaggagcctctccctgaaggtctcttctggctccttctgaccggtgaggtccctaccgagcagcaggtccgcgacctgtccgccgagtgggctgcccgctccgatatccccaagttcgtcgaggagctcatcgaccactgccctaccgacctccaccccatggcccagttctctctggccgtcactgctctcgagcacacctcttccttcgccaaggcctacgccaagggtatcaacaagaaggagtactggcactacacctttgaggattccatggacctcattgccaagctgcccaacattgcttcccgcatctacc

SEQ ID NO: 6856 - DNA, 706 bp, Artificial
  Synthetic
ggcgatggcattggcgatggcctccagggcgcgtaatgcggcgtccaagcttcgccgcatttcggatggatgcgagttgtcgccgcattggttgtttcggcgattgctcacgacggatcttcgatcccggcttatgcaactcattccggaagaacaagagagattgaagaaattgaagaaggagcatggatcggtacccctcggccaagtcacgatcgacatggctattggaggaatgcgaggtatcaaagggatgctatgggagacgtctttactcgacgctgaagagggaatccgattccgaggcttgtcgattccagaatgccaggagaagcttccggctgctgtgcctgatggtgaaccaattccagaaggattgttttggcttcttgtcactggtgaagttcccagcaaggagcaagctgcgaccttgacgaaagactgggcttctcgatctgacattccaggtcatgtgtatgatgttgtgaacgctcttccaaagaacgcgcattcgatgacacagttttcggctggagtgatggctttacaaaccgaaagcgagttccaaaaggcctacgagaaaggaatcaacaaatccaagttctgggagccagcgtacgaagacgcaatgaacctgattgcgaggttgccaggcttagctgcctacgtataccggagaaaataccactctggagagacgatcgac

SEQ ID NO: 6857 - DNA, 625 bp, Artificial
  Synthetic
taaccccacacacatcaacacaatgatccctcttcgaaccgcccgtgttgcccgaacctccgtgtcctccatggtccagaagcgatttgcttctgacctcaagggcgccctcaaggaggccatccccgccaagctggagctcttcaagaaggtcaagtccgagtactcccagaagtctctcggtgattgcaaggtcgagaacctgctcggaggcatgcgaggcctcaagtgcatgctctgggagggctccgttcttgacgctgatgagggtatccgattccacggcaagaccatcaaggagtgccaggaggtgctccccaaggccgttgagggcggcgagatgctccccgagtccatgctgtggttcctcttcaccggcaaggttcccactgaggagcaggtccgaggcctgtctcgagagctcgctgagaagggcgaggtccccgagtttgtcaacaagatgctcgacaacctgccccctaccctgcaccccatgacccagttctccatggccgtgtctgcccttaaccacgactccaagttcgccaaggcctacgagcgaggtatccccaagtccgagtactgggagtacaccttcgatgactccatcgacctcattgccaag

SEQ ID NO: 6858 - DNA, 632 bp, Artificial
  Synthetic
aacaatcgctctctctctctgtccctccccgattcgattcaattcgcgacgcctccgtgaaattctccaaagccagcttgccctgtagccgcgtgctccggccatggcgttcttcaggggcctgaccgcggtgtcgaggcttcgatcccgcgtggcacaggaggccaccacgcttggtggtgtgcgatggctgcagatgcagagcgcatctgatcttgatctcaagtcccagctgcaggaattgattcctgaacaacaggaccgcttaaagaaacttaaatcggagcatggaaaggtccaacttggaaatataacagtcgatatggtccttggtgggatgagagggatgactggaatgctttgggaaacatcattgcttgacccggatgagggtattcgttttaggggtctctcgattccagagtgccagaaagtgctgccgacagcagttaaagatggggagcctttgcctgagggtctactttggcttcttttgaccggaaaggtgccaaccaaagagcaagttgatgctctatcaaaggaattggctagtcgttcgagtgttccaggtcatgtgtataaggcaatcgatgctctccctgtaactgctcatccgatgacccagtttacca

SEQ ID NO: 6859 - DNA, 409 bp, Artificial
  Synthetic
  misc_feature (197)..(197): The residue at this position can be any nucleotide.
agccgcgtgtgtttgatggaacccctcatcttgcggcatgggggattgtcctcaagaggccattggttgggacgggcagaagaagaggccattggttggacgataggcagaggaagagattattggttttacgataggcagaggaagaaagacgccaagtactctgtactacctcacaaggtagcagtccctttttntccattccaacgttctgggatcacccagaactgccgaacgcaaccgcgcccttgccctggagatggcgggagaggaagtggtgttggttgtgagcgccgccccaaacgatgccccgtgccgatacggaggggatagattaggtcggtagtcggggtggtacttgatagacgtcaaatatctgaatgaatcagtaatataattgttaagtagg

SEQ ID NO: 6860 - DNA, 482 bp, Artificial
  Synthetic
attcaatcattcatcatccttctcacctctagatcatcctcatccgtcacaatggctccctctggtatcccaacccaggacgtcgacctgaccgccgccaatatccaggtcaagggggccactcagcccgtgctagatgatgctactggcaactccctctcccagaccatctgcaccgaccacatggtcaccggcaactggactgcctctgaagggtgggctactcccgagctcaagccctacggtcccctgagcctcatgcccactggctcggtcctccactatgccaccgagtgcttcgagggcctcaaagcctaccgtggttatgatggaaagctccgcatcttccgtcccgactggaactgtgcccgtatgcacctgtctgccggccgtatctccctgcctctgtttgagcccgccgagctggagaagctcatcattggcctggtgtccgtcgatggtccccgctggctggctcgcga

SEQ ID NO: 6861 - DNA, 689 bp, Artificial
  Synthetic
aatcattcatcatccttctcacctctacatcatcctcatccgtcacaatggctccctctgctatcccaacccaggacgtcgacctgaccgccgccaatatccaggtcaaggaggccactcagcccgtcaagcccagcaatggcactactcctgctcccctcgatgcctccaagctcacctacacctacactaagaaccctcagcccgtgctagatgatgctactgccaactccctctcccagaccatctgcaccgaccacatggtcaccgtcaactggactgcctctgaaggttgggctactcccgagctcaagccctacggtcccctgagcctcatgcccactgcctcggtcctccactatgccaccgagtgcttcgagggcctcaaagcctaccgtggttatgatggaaagctccgcatcttccgtcccgactgcaactgtgcccgtatgcacctgtctgccggccgtatctccctgcctctgtttgagcccgccgagctggagaagctcatcattgccctgctgtccgtcgatggtccccgctggctgcctcgcgaccagcccggccgctacctgtacatccgtcccaccttgatcggaacccagtcccagctcggtgtccaggctcccaaggaggccatgctgtacatcatcgtcacctacatgcccaagctcgacagcccccct

SEQ ID NO: 6862 - DNA, 324 bp, Artificial; identical to SEQ ID NO: 974
  Synthetic

SEQ ID NO: 6863 - DNA, 614 bp, Artificial; identical to SEQ ID NO: 4596
  Synthetic

SEQ ID NO: 6864 - DNA, 554 bp, Artificial; identical to SEQ ID NO: 348
  Synthetic

SEQ ID NO: 6865 - DNA, 851 bp, Artificial
  Synthetic
agtacagagagagcgatcgatcgaggagagatggaggcggagaggaaattgaggatgcgccagcaagtgctgctggatcatctccggccgtcggcggcgcctcgccctgtcaatctcgtgacctccatttgctctgctggggattccgcggcgtatcctagaacgactgatttctccgacgatgttgtggttgtagctgcttataggactcctatttgtaaagccaagcgtggtggtttcaaggacacctaccccgaggacttgctgactccggttctaaaggctgttgtggagaaagttggtttgaatcctgcggaagttggagacatcgttgttggaagtgtgcttgctcctggatcgcagcgtgcgaatgagtgccggatgtcggcattttatgctggatttccagaaaccgtccctgtgcgcacggtgaacaggcaatgctcttctggtcttcaagctgtggctgatgttgcagctgcgatcaaggcgggtttttacgatattggcattggtgctggtctggagtctatgtcggtgaacgggatggtctgggaaggctcagtaaatccaaaggttgagatgaaccaaaaggctcaagactgcttgctaccgatgggcattacctctgaaaatgttgctgagaggtatggagtgaccaggcaggagcaagatgaagtggctgttacctctcatcgtcgtgccgcggctgcaactgcaagtggaaggtttaaggatgagatcattcctattccaacaaagcttgtcgatccgaaatctggggaagagaagcaagttgtgatttctgccgatgacggctttcgcccgaatgcaaaggtcgctgatcttgc

SEQ ID NO: 6866 - DNA, 668 bp, Artificial; identical to SEQ ID NO: 4588
  Synthetic

SEQ ID NO: 6867 - DNA, 648 bp, Artificial; identical to SEQ ID NO: 4598
  Synthetic

SEQ ID NO: 6868 - DNA, 671 bp, Artificial
  Synthetic
atttgtactaaaaaaataatcttgagatcaaatggagaaagcaattgagagacaaagagttcttcttcaacaccttcgtccttctcaaacttcttcttccttggaaaatattgaatcatccattgctgcatctgtatgctcttctggagacagtgctgcttaccaaaggacctctgtctttggagatgatgtcgtcatagttgctgcatataggactcctctttgcaaagcaaagagaggaggcttcaaggatacttatcctgatgatctacttgctccagttctaaaggcgttgatggaaaagactaatgtgagccctagtgaagttggggatatcgttgtcggcaccgtgttggccccaggttctcagagagcaagcgagtgcaggatggctgcgttttatgctggttttcctgaaactgtgccagttagaactgtaaaccggcaatgttcatcaggccttcaagcagttgctgatgtagctgcagctattaaagctggattttatgacatcggtattggtgctggattggagtctatgaccacaaacccaatggcctgggaaggatcagtcaacccaaaagttaagatgatggcacaagctcaagactgtcttcttcctatgggtattacttctgagaatgtagcacatcgttttggtgtgacaaggc

SEQ ID NO: 6869 - DNA, 163 bp, Artificial
  Synthetic
tgcgagcaaacagaaagcagcccgtcatccttcgggaacccgcatgatcagcgcctggccgtctgggggtggctgagaggtcgctgggtcgcgggttaatgaaacacgggctctgcgtttatttggtggtgatcgacacttttgccctcgcagcgtgaggact

SEQ ID NO: 6870 - DNA, 627 bp, Artificial
  Synthetic
tttcctaccaattcatccctccatataataaaaaccatgtgtggtacagacgcccccgacgccgccgctggtcccgtgtccaacgggtcgcatgccagcaaggccaacccagccagctctccgtatcagaacgtcaacgacttcatctccaatgtcgcccgattcaagatcatcgagagcactcttcgtgagggcgagcagtttgccaatgccttctttgacactgaaaccaagattaagatcgccaaagctcttgacgagtttggtgtcgactacatagagctcacaagtcctgtgtcttctcctcagtcatatgaggattgtaagactatctgcgggcttggcctgaaggccaagattctcactcacgtgcgatgcaacatggaagacgccaagaaggccgtcgagtgtggtgttgacggcgtcgacctcgtcattggtacttccagcttcctacaaaagtacagccacggaaagagtatcgctatcatcaaggagactgccctggaagtgattcagtatgtcaagagccagggcgtagaggtccgcttctcttcagaggactcgttccgaagtgacctcgtcgacctccttactctctacaaggctgtcgatcaggctggagtt

SEQ ID NO: 6871 - DNA, 581 bp, Artificial
  Synthetic
atcgcatctaccgaactccggagttctcgcaaaaggttcgcacattgtattttcgaaagcgaagatacacatatacacaaacaactacaatatgtcggagaaccctacgacaaacgggcacgacgcccttgaagagaagctcggccgcctggctaggaaacccggcatcaaggccagcctcgttttggaccgagcaaccggcgcaatcctcaagacgagcggccagatcgacgcgctccagacggcgaaatcgcgaaacgcgtcaacggcggcctcattctccaacgacgctcccgcagcggaggagggcgaggcgcagggcgtcgaagagtttgcggaaatgatctggaactttgtcaacagctccgggcagctagtcggggacattgacacagaggacgaattgaaattactgcgactgcgaacgaagaagcaagagattgtcatagtgccggaccagaagtacctactgacggtcatccacgatactcagccgggctgattacacaatttggagcggactttccgatacgcaaagcagcgggtttattaaaggggctactatgatggaatataatact

SEQ ID NO: 6872 - DNA, 106 bp, Artificial; identical to SEQ ID NO: 5100
  Synthetic

SEQ ID NO: 6873 - DNA, 662 bp, Artificial
  Synthetic
gcgacaaaacatcacagtgcacatcatggcgcgagtacttcgcaatagagcggttgcgtcaccgaaaaccaccgacgccgtaaagcctgacagcaccccaaagggcaagagaaaggccgccgaagagtcttctcccgttgtgctgaagaagcagaaatccgccaagaaggaagatgtcgagaccaaggcagccaagtcacccaaggcagccaagtcaccaaagactaagaaggaggaaaagaagaaagaagaagaaaagaagcaagatgtgattgacatggaggaagattccgagtctgagggacaagaagatgagggaaatcttcaggctttggccgtcaacattgacccggaagaagaggcccccgtgaacgacgaagaattccagcccggtcaggacgttggcaagatccccaaggtctcgaaagacgtccagaagtcgatcaaggcatcgaaggaagaacctggcgtcgtttacattggccgaataccccatggtttctacgaatacgaaatgaggcagtacctgtctcaattcggccccatctcccggctgcgtctatcacgcaacaagaagactggcgccagcaagcactttgcctttgtcgaattaacgaagccagcactgccgagattgtctcaaagaccatggacaactattt

SEQ ID NO: 6874 - DNA, 446 bp, Artificial
  Synthetic
tgcagatgcgtgagaacttcctcccatgtgttcaagccgagagctgctgcagccacgctcgcttgatctgtgaaccattcgtggttcctggttccaacggtggccaccatgccgacggaaatagcccagatccctagtggatcgctgatatgatcatttctcagcagggccgccagatggcccttgagctgaagaatgatggcatttgctaagccgacgtgggaataataagtggtgccatgtaagattagcatataaagtgcggtcgcgtatcggagacactcagaggtggccgattgcactgggtctgcatttgcatccaggaatggaggcagcagcagcaatttgtgcataacaaaacaggttagatcatgcagctgcgtattggtcaagcttgaatgccatgaatgatgaaagatgttcctgagccgaagaaaaaaaaaaaa

SEQ ID NO: 6875 - DNA, 627 bp, Artificial
  Synthetic
attaaaagatgatgatgatggtgcaagcatgtcctctctctcacaactctctcccaactccatcacacttgcaatctctctctcccatgctatcaagcaagggagggaggggtaaggggagcaaaagcatagtgaaggcttccttattgtgggagcccaattcaacatcaatcctcctagagagcatagcacacccacactcttggagtgccctcctccctgtgatggtgatagacccttggtcccccaacataaaggcagatagcatagcctctcagctctttgcagcctccctcttcccctacctgggcttcctttaccacttgacaaagtcaaagacttcccccaacctcaccctctttggcttctacttcttgcttgtctttgtggctgccactattcctgccggcatttatgcaaaagtaaagtatggaacatccttagcaaatgtggattggcttcatggaggcgctgagtcttttcttacccttacaaatcttttcattgtaattggattgaggaaagctttacgcggcgatgatagtgttccaaaatctttctcagcaaaggacggtgaaaccatagaagagagctcacccctttcaaataaatgtatggctgatgagg

SEQ ID NO: 6876 - DNA, 739 bp, Artificial
  Synthetic
cccacgcgtccgctctttccttctgtcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttag

SEQ ID NO: 6877 - DNA, 856 bp, Artificial
  Synthetic
cccacgcgtccgctcgatttcagatttaagatctcagatacaaaactccgacatgtctacgttcagcggcgatgaaacagctcccttcttcggcttcctcggcgctgcagccgcactcgttttctcctgtatgggagctgcttatggaaccgcaaagagtggtgttggtgtggcttctatgggagttatgagacctgagttggtgatgaaatctattgtccctgttgttatggctggagtgttgggtatctatggattgatcattgctgttatcatcagtaccgggattaaccccaaggctaagtcttactacctctttgatggatacgcacatctctcgtctggtcttgcttgtggtcttgctggtctctcagctggaatggccattgggattgttggtgatgccggtgtcagggcaaatgctcagcagcctaagctctttgttgggatgattcttatccttattttcgcagaagcgcttgctctttacgggcttattgtaggaatcattctttcctcacgagctggccagtctagagctgaatgagaatctaaaccacaagactgctcaaaggtacttcctttacttctgtgtgcgttttgttttatcgtgattagtatgatgtatcatcgggaaccaaaaattttactggattcttggaaatttgtttcggaaacaaaaccgcctatcttcattctccttttcttttccggtggttactctccgatgtagaattttattgtttgattctgtaataaagaagctctgaggagtttggtatgtttttgtattcttgtatttgtcctgaggaagttaaatacatttatttgtaaagaagtttgcttttctgaaaaa

SEQ ID NO: 6878 - DNA, 831 bp, Artificial; identical to SEQ ID NO: 4866
  Synthetic

SEQ ID NO: 6879 - DNA, 701 bp, Artificial
  Synthetic
  misc_feature (152)..(152): The residue at this position can be any nucleotide.
  misc_feature (157)..(157): The residue at this position can be any nucleotide.
gttctctacaaatagcctaaggtctctcccctaaattcatttcatcccggccatcaattgctttctttcactcttcttctacaactctataaatccgttaatttcatagagctgagaaaactaagacgatgaatagttgcagtagcacttanggtangggggtcattgcacttgtggtatgttttacaatcaaaacaatagtagtactgcttctgcctactcgatgctctataaccagaatcagacaactccttttgaagaaaattattctgatcagaacacgtattcttttgcttcttctacatcatctaattcagtggattgtacactttcattagggacaccttccactcgtcttagtacaagcaatgacaataatgaaaagcgacttcagtctaatgaacgttgctctaattcttacatgtccaaatgctggaatattttacagcccaaaaatcacaagtccagtcgcggtagtagcaacggcaacactaactcaggcggtgctgatcctcttgttgctcgccgatgtgctaattgtgacaccacttcaacacctttatggagaaatggtcctagaggccccaagtcactttgcaatgcgtgcggaatccgtttcaagaaagaagagaggagagccagtgcggcggcggccaccgtaaacggtggcggaatggatcatactcagcacatgataaacg

SEQ ID NO: 6880 - DNA, 637 bp, Artificial; identical to SEQ ID NO: 1124
  Synthetic

SEQ ID NO: 6881 - DNA, 267 bp, Artificial
  Synthetic
cccacgcgtccgaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatct

SEQ ID NO: 6882 - DNA, 676 bp, Artificial
  Synthetic
gcggcacggaggcgtttccaaatctcggcaagcactgcaaccactcctcgtgtggccagctcgatttcctgcccttcaaatgcgatgcgtgttccaaggtcttttgcctggatcatcgttcctatgcagctcacagctgccccaaggcgaattccaaagactctacagtgatcgtctgcccgttctgtgcctcgggtgtcaagaccgtggcaggcgaagatccaaaccttacaatcgacagacatctccagacttcttgcgatccaagcaactacgagaaggtgatgaagaaaccaaagtgttgtgtccgaggttgcaaagatgtgttgaccttctccaacaagttccactgcaaggtctgccgcaaggacacctgcatgaagcacagattccccgcagaccacgcatgccaggccgcggcatctgctcccaagtccgcacgaaacgttggtggcgagctggcgacgaagttcttccaggctttgtcgatcaggacgggcagcgagtgtgggactagcagcagcagcagcaacagcagcagccgaagcggcaaggttagttcctcgacgtcgaagtggccaaggattttctagcggtgtgggaaaatggcataagtccaggacatttacggacttttacagggatactatagatgcctagaaagatcgtgccacag

SEQ ID NO: 6883 - DNA, 845 bp, Artificial
  Synthetic
ttatcaccatgttggtccaccactatcaccacctaggatgattccgctccatagctcattgcttgaaccaccttctctcttcttattaccatcatcgtgtctcacatggtgatgttgttgacggtcttcatgatctccataaggatacatcatcttacttccttcctcattaacaacgaagttatcatgattaccaatctcttcctcgttcctgtctaatgaaaacccaagattctttttggggtgctcatgatcatactcttgacgaaactgaatcattcccataggagcttggaaaagacagttctgccctcctgtcacaacttgctcactgaaatgaccgtaatgcccttgagctcgcttgtcttgcataggggaggagaaggataggctgaggtcattattgttttgatgcgtcttgctagggtttgatgatgaagctgatgatgtgaagacgaaaggagggttgagatccgggaggttcttggtggaagaagaagtagaggaattaggaaatggaagcttcttgttctttctagaacctccgcctacggggacgttacggagagagccaccttcagtccaatatctccgacaagacttacacaagtacctaggctgtgctaagctgtagttgttgtaataacaaaacttggtgttgcttgagttgcatcttggacagtttcttggttcttgtggcctagtgctcattgtcgtcatcaacttcttctcgtcatccattatcatagttgttgctgttgttgaatccattgttgttgttgttggtggtggttgtgttgtgacgatggtgttataggaattattgttagtactagtcatgctgc

SEQ ID NO: 6884 - DNA, 80 bp, Artificial; identical to SEQ ID NO: 1076
  Synthetic

SEQ ID NO: 6885 - DNA, 705 bp, Artificial
  Synthetic
aacttaacagtaaagcagctgcaacttggaccacccccttccacctctccccccacacaagtcccacccctgcctttttcttccttcttattacaagctcagcaccctgcaattcctttccactacacatatatcatactcccacaaagcatatcaatcttctatctcactatccctctatctactaataagaatacttagagagcttatcgagtactgcagttgaaatgagtgtcatacagtaactaattaattgggattacttctctacgagtttgcatggattcctccaactggttacagggcacaattcacgaggagggtgcagcaggtatagattcttcttcatcgccaatatcagaggaaattctcacatgctcaaggccattaatagtagaaagaaggctaagacccccacatgaccattctatcaaatgccctcgttgcgactctacccacaccaaattctgttactacaacaattacagcctttctcagcctcgctacttttgcaagacttgccgtaggtactggactgaaggtggtactttacgaaacatccctgttggtggcggctgtcgcataaacaaaaaagtctcctccaaaaaatccaatattgaaacagctaataataaccaaaatcctactgatattcagctttcattcccagatcaaatgccacccttttctcatcatcacttcatg

SEQ ID NO: 6886 - DNA, 100 bp, Artificial
  Synthetic
gcagctttctgcaacttctccaaatctcatactttccagaaaatcattttcccaagaaaaataaaactttcccctttgttcttctccccccaacaggtca

SEQ ID NO: 6887 - DNA, 663 bp, Artificial
  Synthetic
gcagcatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatat

SEQ ID NO: 6888 - DNA, 577 bp, Artificial
  Synthetic
gctgtgcgtctcaagagggatacccggatagggtggagcagcagcgggatagggctattgtggatcgattcttcctcctcgatctgtggggatcgctttgatctataggcgcagagcgcgattcgcggtcttatgaatgctgggcagctggaaatggtagggttgatggcgaatccagcgcttccatccgacgaagcggtgtccaagaagatccggaagccctacaccatcaccaaatccagggagagctggaccgagcaagagcacgacaaatttctagaggccttgcagctgtttgatcgggactggaagaagatcgaagcgtttgtaggctctaagacagtaatccagattagaagtcatgcccagaaatattttctaaaggtccaaaaaaatgggaccggagaacacgtccctcccccaaggcccaagcgaaagtcggctcaaccatatccacaaaaggctgtcaaaccagctcccacttcgcgggcaactccacaacagtcaccaccggattttgcttacatggttccgcagcaatgtaatatgtatgttccagcagtcactggaaatcccg

SEQ ID NO: 6889 - DNA, 671 bp, Artificial
  Synthetic
gcagcatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacctcctcgacctaagaggaaagcgagtcatccttatcctataaaggctcctaaaaatgttgcttatacctctctcccgtcttcgagtacattaccgttgcttgagcctggttatttgtatagccctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtt

SEQ ID NO: 6890 - DNA, 560 bp, Artificial
  Synthetic
tggtatcaacgcagagtggccattacggccgggatggcttctcggaccataccaagctcattgggctcagctgtgaatttttcatcgaaatcccaaattactagtaacccattgtcttgtgtaactttcggagcgctaaacagacctagaagcaggatttccgtctcaattcgtgcgatgggctcctcagcttcttctcaaaaaccagacagtgctcaacgggcaagcaaagtagattatagctctgtaagtgatgaggagtggaggaagcagctaacgaatgaacaattttacattacacggcagaagggtacagaacgggcattcactggggagtactggaacaccaaaatccaaggaacatatcattgcgtctgctgtgacactcctttgtttgaatcttctaccaaatttgacagtgggatggggtggccatcttattaccaacctgtagacaacaacgtgaagtcaaagatggacttgtctattatcttcatgcctcgtcaagaagttctatgtgcagtttgcgatgctcgtcttggacacgtgtttgatgatgg

SEQ ID NO: 6891 - DNA, 681 bp, Artificial
  Synthetic
aggggatatatatatttcttccacttttggctcctcctcctccttcttcttccccctaagcctagccatagccatagccctagccctagttgtgattctttagagcgagcatatccctttgggatggcttcctccggcagttctcccttgcaagtgcagaagacagaggaagaatggcaagccaccctcaaccccgagcagttccgcatcctccgtcagaagggcaccgaatgggcaggcacagggaagtacaacaaattctacgaggagggtgtctatgaatgtgcaggttgtggcacaccaatctacaagtcaaccactaagtttgactctggctgtggatggcctgctttctatgaaggcttacctggtgctattcacagaaatgttgacaaagatgggcgccggatagagataacatgtgctgcttgtggagggcatctgggccatgtatttaagggggaaggctttccgactccaacagatgagaggcactgtgtcaatagtgtctctcttaagtttactgaaaccacttcgaagccacatgatgcatctaaaatttaaacaggtatttggtttctggttttgggtttccttcggtatctagttttgggtttgctgtatagtgcaactgaatccacttctagccataagattcatctaaaccggtatctggtatct

SEQ ID NO: 6892 - DNA, 674 bp, Artificial
  Synthetic
tggtatcaacgcagagtggccattacggccggggggaaacctaaaaaaaaaaaagaaaatgattctgaaattctcaccattttctccttcgcgaactctgattttcaaccccaggttccaacgcagaaaagcaatccacattcatggcctgtccaatacccaattcagatttgtagccatggctggagggtccgttcagaagtcagaggaggagtggcgtgccatcctctcccctgagcaattccggattctgaggcagaaagccacagagaatccagggagaggggagtataacaagtttttggtgtaggcacctacctgtgtgctggttgtggcactcccatctataggtctgcaacaaaattcaactcaccctgtggctggccttctttttatgagggtctccccggggccataaatcgcaatcctgacccagatggggtgaggatggagataacttgtgctgcttgtgggggtcatcttggtcatgtttttaaaggtgaagggtttcgtaccccaacgaatgagcgccattgtgtcaatagtatatccctcaagttcaaaccaccaaatttttaatgcctcgtgccgagtatgcaacgattactatgaactttaatcttttctcttgcatttgtctcgcaaagattgatgctttattaactgctaatgac

SEQ ID NO: 6893 - DNA, 723 bp, Artificial
  Synthetic
gacaaatgctttgaatcgtctttgcgtcaaccattaaaaaaaatactaaacaaataaatactatagaagcttatcttgatgggttctcagattctcaaaatctcaccttttgcttcttcttcaatttttaaagccaccccagtcttgagattccaagccaaaacggtagtcaccatttctaagatccaattcaggtcaaatcctctcatttcctcatctgggtttgttcctttaagtaataataagagaggtttgagaggtggggttgttgctatggcttctgcaacaggagggtccgttcagaaaacagaggaggagtggcgtgctattctttcccctgagcagtttcgtattctcagacggaaaggcactgagtatccaggtactggggagtatgacaagttttatggtgaaggaatctaccaatgcacaggatgtggcactcctctctacaagtccacaacgaaattcaactcaggctgtggttggccagctttctttgagggtcttccgggagctattaatcgcactgctgaccccgacggcaggaggatcgagatcacttgtgcagcttgtggcggccaccttggtcatgttttcaagggtgaggggttccctaccccaacagatgagcgccattgggtcaacagtatttccctcaagtttaccccagaaaattcataatccattgcactgatgatgttatgattatcacagctttat

SEQ ID NO: 6894 - DNA, 782 bp, Artificial
  Synthetic
ccccccccgctggtcctgtgggcttttaagcggcgtcgccggtggccacgcacgcacccaactctcacctactctgcttctgctgccctcctgcatcgactcactcctccactcccgtgtcgtcgtcgtcgtcgtcgtctgcttcgtcggccgccgcgcgccgcccgcgatggcgtcgtcgggggacagcagcggcaagcagcggagcgacgaggagtggcgcgccgtcctctccccggagcagttccgcatcctccgcctcaagggcaccgagttacctggaacaggtgagtacaacaagttctatggtgatggggtctacaactgtgctggctgtggaacacccctgtacaaatccacaaccaagtttgattctggttgtggctggccagcattttttgagggacttcctggagccataaaccgaacaccggatcctgatggaaggagggtagaaatcacgtgtgcagcttgcggtgggcatttgggtcacgtgttcaaaggagaaggcttcaagacgcctactgatgagcgtcactgtgtgaacagtgtttcgatcaagttcaccccggcctcctaaatcctttcccaggtcattattattggaggtgaattccccagggctaaagctgtggaaagcactacaaaataatgaataaaatcacagagacatatcctgtttgtccatatatgaattcatctcctgttaatttagctgtaaacttgtaacttaacattgctgggaatggtaaatgaatgaataaatgaatctggttcattac

SEQ ID NO: 6895 - DNA, 434 bp, Artificial; identical to SEQ ID NO: 998
  Synthetic

SEQ ID NO: 6896 - DNA, 428 bp, Artificial; identical to SEQ ID NO: 996
  Synthetic

SEQ ID NO: 6897 - DNA, 635 bp, Artificial
  Synthetic
cttccgtgttcaattatgtacggatatgaacttctctggttatcagaaaaaagtagaactggaagtgtaaataggttacagccaaaagttttcgacaatcatcagacttggtatttcgcattattgacaaaccgcagagtataaattgctttctgaaaaatccgatacttttttaataatcacaggtttactatgactgcgcagactgttctattgcgggcttatacttccatgctcaaagcttactatcttctgaggctggaatgaacttgagtgagatactgttaacacaatgccgctcatctgtaggcgtgttgaacccctcccctttgaagacatgtcctaaatgtcctccgcaagccgcacaggtgatctctattcgcctgccatcaggatcaggcgttcgtgcgatggctccgggaaatccttcatagaatgctggccaaccacaacctgagttgaatttagtagatgacttgtacaatggagtcccgcatccagcacattcataaacaccctcagcgaagagcttgtcatattcacctgttccaggatactccgtgcccttgaggcggaggatgcggaactgctccggcgagaggatggcctcccactcctcctccgacttctgcacg

SEQ ID NO: 6898 - DNA, 1060 bp, Artificial
  Synthetic
gcgccaatgtcgcccgggacgatctatctcgatgtcccggaatcgccatcgctcgacagcacggaatccacggccgatgccgatgtggtgtcagtgaccgcggtgggggcagcagcggcagcggcctcctcgacgccatcggcctcttccggatcgtccaaggcctgccccaaatccaccagcagcgtccatgagctcctggaatgcccggtttgcaccaactcgatgtatccacccatccaccagtgtccaaatggccataccctttgttctacttgcaaagttcgtgttcacaatcgttgtccgacttgccgatacgagcttggaaacattcgctgcctggccttggagaaggtggcggaatcgctggagctcccctgcaggtaccaggacttggatgcccggatattttcccttactacagcaagctcaagcatgaagctcagtgttgcttccggccttacggctgcccctacgcgggatccgagtgctcggtcagcggcaacattccgactttggttgctcacttgcgagacgatcacaaagttgacatgcacaatggctgcactttcaaccatcgctacgtgaagtcgaatcctcaggaagtcgagaatgctacttggatgctcacggttttcaactgttatggacaacacttttgcctccactttgaggcattccagctggggacaatgccggtgtacatggcatttttgagattcatgggggacgacaacgacgccaagaacttcagctatagtctcgaggtcggggcaaatggcaggaaattgatgtggcaaggtgtcccgaggagcatccgggactgccacaagaaggtgagggacagccacgacggattgatcatccagagaaacatggcactgttcttctccgggggtgacaggaaagaactgaagctgagggtgacgggaagaatatggagggagcagtagtgcaagtttcttaggcagggaaaactagaaagggagctctgtagccactatcaatttcatgctctttgaaattgttggcaatgggaaaggtgggaggatatatatta

SEQ ID NO: 6899 - DNA, 573 bp, Artificial
  Synthetic
attgcaccagaaagttctgaattaaaaagctccccttttagaaaatcttcagctattactggtgggaagcatggagcgggatctaatagtgctgttcatgaactacttgaatgccctgtttgtatgaatccaatgtacccgcccattcaccagtgtccaaacggccacacattatgccacaaatgcaagaaaaaagtacatgtatgcccaatttgccgccatgagcttggaaacataagatgtctagcgctggagaaaattgctgaatcgctggaattgccatgccgataccaaatttttggctgtcaagatatattcacctatcagactaggcttctacatgagcagaactgcagatttcgaccatacaattgcccgtatgcaggatctgaatgcgctgttactggtgatattcagtacctcgttacacacctaaaagatgatcacaaagttgacatgcatgatgggtgtaccttcaaccatcgttatgtcaaatctaatcctcaagaagtcgagaatgctacatggatgttgacagttttcaactgttttggtcaccagttttgcctgcac

SEQ ID NO: 6900 - DNA, 349 bp, Artificial
  Synthetic
cccacgcgtccgcatcaaaaccatttcatccgtagtggtcaatggcggcttctccgttggtggttcagaaaacagaggaggagtggcgtgcggttctttctccggagcagtttcgtattcttcgtcaaaaaggcactgaaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaacccctgatccagatgggagaagaactgagatcacttgtgctgcgtgcgatggaca

SEQ ID NO: 6901 - DNA, 612 bp, Artificial
  Synthetic
agggttcttggaggaatggcgctctgcggagcaggggcagcgatggcgctggatctagcgccgcgaatgcggcccctagttcagcttggatcgtcgtgcagaggccagcgaatgcgggcaatgtgttcggtcgagcgcattcaccggacggaggaggagtggagagctgtgctcaatcccgagcagttccggatattgcggacgaaaggaacagaaatgccaggaactggcgagtacaacaagttctacaaggacggtgtctacaactgcgggggctgtggaacacccttgtacaaatcgacagcaaagtttgattccggttgtggatggccagctttctttgagggtctcccgggagcaatcaaccaaacggttgatgccgatggccaccgcactgaaattacttgtgctgcctgcggaggacacctcggtcacgtctttaaaggcgaaggctttccaactccgactgatgaacgccactgcgtcaacagcgtgtcgctcaagtttgtccccggcaacaaggacgactaaaaccgaaggcgacggaactgcattatatatgactggcaaataaaccgtcaatgttctagtcaaggcttagtccacgtacgt

SEQ ID NO: 6902 - DNA, 411 bp, Artificial
  Synthetic
ccccccccccggaatctgacacgtccacatcgccagttagagcagttcgaggaaggaggaggaggaggttgattcgatggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccaggtgtctccgaaggtggagcgccgcccgttcacggcggaggaggacgccgcgatactccgggcgcacgcccgcctcggcaaccggtgggccgacatcgcgcgcctcctccccggccggaccgacaacgccgtcaagaaccactggaactcctccctcaagcgcaagct

SEQ ID NO: 6903 - DNA, 680 bp, Artificial
  Synthetic
gcagcatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctct

SEQ ID NO: 6904 - DNA, 932 bp, Artificial
  Synthetic
cccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctagaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctcatagtttttagcattttaatgaaatatttcaagtttccgtgttacaaaaa

SEQ ID NO: 6905 - DNA, 637 bp, Artificial
  Synthetic
gaggctccgcctcccaccaccgtcaaattgtaaatttggtttttcctctccgttaatcaccggaaatctctcgattccggtttgtcataatctatctcagttacctttttctgtctcttaccagtttctatggcggcgattacacaacgaaaagaatcggatcggattaagggtccatggagtcctgaagaggacgagctgttgcagactctagtggagaaacatggacccagaaattggtctttaataagcaaatcggttccgggtcgatccggaaaatcctgcaggctccgatggtgtaaccagctttcccctcaagtggaacaccgtgctttcactccagaggaggatgaaaccatcatcagggcccacgctaagttcggtaacaaatgggctactattgcccgtttactatcgggtcggaccgataacgctattaagaaccactggaactctactcttaaacgtaagtgttgttccatgtctgaagatttaagctttgaaactcctcaacagcctttgaaaagatcgtctagtgtcggtcctagtaacaacttttcttctggcatgaatccgggtagcccttccggatccgacttgagtgattcgattccttcgggttttacccaatcgcttg

SEQ ID NO: 6906 - DNA, 272 bp, Artificial
  Synthetic
cccacgcgtccgcaatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagct

SEQ ID NO: 6907 - DNA, 462 bp, Artificial
  Synthetic
tggtatcaacgcagagtggccattacggccggggggataataaaagaacatgcaatatttctcaagatgttgaagttaggaaaggtccttggactatggaagaagatttgattctcatcaattacatagctaatcatggtgaaggtgtttggaattcccttgctcgatctgctggtctgaagcgtaccggaaaaagttgtagactccggtggctaaactatctccgtccggatgttcggaggggaaatattacacctgaagaacaactcttgattatggaactgcatgccaaatggggaaacaggtggtcaaaaattgtaaagcatttgccaggaagaacagataatgagataaagaactattggaggacaaggattcaaaagcacattaaacaagcagatcaaagcatgaatattagagcatcatcaaattctgaggacaaccatcatcaacaagctagta

SEQ ID NO: 6908 - DNA, 1117 bp, Artificial
  Synthetic
aaaaactaaagctaacacttgtttctttttcttttcaatgggacattcctcctcggtactggtcttcttttcacacatagatgggtagttttcatgatatttctagcacaggcctggttttaggattaggcttttccacaacggttgatcagaaatcaacaaaaattctactggccggcaaagggccgtctcttggctttgaaccgtcactaacgttaagcctttccggtgatcatacctataatgaacagcagcaggcagctaagaaggttaagaatgatcatcaatcggctgatttgtatcgtcaagatagtgcagcttcctcctactcaaatgctagtgtgaaaagggagagagacgctggaagtgaagagataacgactgaggtagagagagtttcctcccgagttagcgatgaagatgatgatggttctaacgctaggaagaaacttaggctcactaaagcacaatctgctcttttagaggaaagctttaagcaacacagtactctcaatcctaagcaaaaacaggacttagccagggatctgaatctaaggcctcgtcaggttgaagtctggttccagaacagaagagccagaacaaagctgaagcaaacagaggtagactgtgagttcctgaagaaatgttgcgagacgctaacagaggaaaacaggaggcttcacaaggaattgcaagaactgaaggctgtaaaaatagcgcaacctttgtacatgcagctgccggcggacatgttaaccatgtgtccttcttgcgagaggatcggcggcgtcggagaaaatccgtcgaagaatcctttcactttggctcagaagtctcacttctacaattccttcaccaatccatcagcagcttgttaagtagagggcatatataaattaaataatatactctctaatagtatattataccaatatcatctttacaatatgatctcccaaggccgccactttttttggttaagggcttgtatgaaatcaactgagtagtgcagtagtatgtgtagagttagatttaaggtcactaatcaatcattttaatttgtttcttatgatcatataataagtccgtaaatagttaaggaatataatacatatat

SEQ ID NO: 6909 - DNA, 475 bp, Artificial
  Synthetic
tgagtctaagcttattaggatcatcaggagaatctactactcctaatgatagtactattcatcaacataaaaacaagagaaaattaaaccaagatcaagaattagatattaatcctctcccttctttaactctttgcttatcatcttcagctgttaattcgtcggtagtaagtgctgcagtttcttcattttctaactcaagtgtcaaaagggaaagagatgctagttttgaagaagaagtagaattggataccaataaagtaattatttctccaaagttagacgatgttgatcaggaacaagatgaagatcatgagtttggtaccaggaagaaacttagacttactaaggagcaatctgcggttttagaagatagcttcaaagagcatagtactcttaattctaagcaaaagcgagatctagcaacacgattaagtttacgtcctcgacaagtggaagtatggtttcagaatcg

SEQ ID NO: 6910 - DNA, 654 bp, Artificial
  Synthetic
ctctcctatttgaaaaagttgaaatctttttaagtttattttgaagaatattattgaagatacaaaatgttggaaaatcaagatttgggattaagtttgagtcttagttttccagaaaacaaaacaacaaattcattgcagctgaatttgttctcttctttagcttcttcaacttctccttctccttcaccttttaatctatttcagaaaacttgttggactgactcatttccttcttcagatcggaacttggagacatgcagaacttttttgaagggaatagatgtaaacagaattccaacaattacagatgcagaagaagaaggtggagtttcttcaccaaatagtactatttcaagtttgagtggaaataagagaattgaaagagaaataaattgtgaggaagaattggattgttgtagaggtattagtgatgaagaagatggagaaacttgtagaaaaaaactaagacttactaaagatcaatctgctgttcttgaagagagttttaaagaacacaacactctcaaccctaagcaaaagcaagctttggcaaagagactaggattgaaacctaggcaagtggaggtttggtttcaaaacagaagggcaaggacaaaattgaagcaaacagaagtagactgtgaattcttg

SEQ ID NO: 6911 - DNA, 410 bp, Artificial
  Synthetic
ttactaatgagaaccagagcaggtcgttgccgtagaggcatggcagcccacggactcatcggacccatcggagacgatgaattcatcacaggaggagccaccgatgacgaagatgacgtaacagcgactcgctcgcaagaaggacacattgtgagagtagtgggaggtttcatgtgcatgtataagtgtggagaaagctttaaagccctaagctcactcacttccttttgcaatctccgattctcatccgttagattctcgcaacatctcttaagatattcacagtctacttccgtttgcttcagcttcgtccttgcccttcggttttggaaccacacttcaacttgtctcgtcctcagattcaattgcttagccaaagccatcttttgcttcggattgagtgtactatg

SEQ ID NO: 6912 - DNA, 373 bp, Artificial
  Synthetic
ttattaggacctaggacgaagagcgtcaaaagtcaaaccgtgagatatcctcgtcgcaggagcccacgcattgaccggcaacgaccggtggtgcgctgacgtaacagcctgaggttgtggtggcgggaccgacacgtgtgcacatgaagggcacatggtcaaagtagtgggtgggctcatgtgcatgtagaactgaagagagagcttaagtgctctcaattccgttacttctttttgtaaccgacggttctcttccgttagattctcgcagcatctccgtaagaactcgcagtctacctccgtttgcttcacctatgttcttgctcgtctgttctgaaaccaaacttccacttgtcttgctcgtaaccctaat

SEQ ID NO: 6913 - DNA, 528 bp, Artificial
  Synthetic
gcagcatgatgttcgagaaatacgatctgggtctaagcttaggcttgaattttccaaagaaacagatcaatctcaaatcaaatccatctgtttctgttactccttcttcttcttcttttggattattcagaacatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacagtctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttacgagcaagacaagtggaagtttggtttc

SEQ ID NO: 6914 - DNA, 590 bp, Artificial
  Synthetic
cgccacttcctcaccttggcttctcccacacgcagcagcagcagccgccgccgcctcgtttgctcgccgcgtccacgaccggtggttgccgcggtgaccggtagctcggtgtcgcccccaccgtccggcctgcgttgcaaaggcgtgacgcgagcttttatgctcgaggcagcttgcttcttggacgctagtagcagcagcatcggcgggagtggtacccgcgtccacggaacttctgcaaaagaaagattctcggatggaggtcgagacgtcgtccgggacggccgagcgcggggcgggcgcgggcgcgcagcagcagcctccgccgcagccgcagccgcagccgccggccaagaagaagcgtgcactccccggcatgccagatcctgatgcggaggtgatcgcgctgtcgcccaagacgctgctggcgacgaacaggttcgtttgcgagatctgcaacaaggggttccagcgcgaccagaacctgcagctgcaccggcgcgggcacaacctgccgtggaagctgcggcagcggagcgggaaggaggtgcggaagcgggtgtacgtgtgcccggagccgacgtgcgtgc

SEQ ID NO: 6915 - DNA, 884 bp, Artificial
  Synthetic
ctttttagaaaatttcatttatagcaaagggttacatattagaagtagaggaaaaataagaaaaggggtatcaaatagctcaccatgggaggataattctcttcctcttactcactcactcttctattttattagctcaaatcagttcagcaccaacttgtgttttgagagggttttccatataagctcaagaatttagcccaaaagaaagatggctgcagggccttcatcagctgtgtttcttgcaatgagagaagaagaacaaaaccaacagatgaaacaacaacacgaacttctcattcagcagcaaccacaacaacagcaagcaccacaaaagaagagaagaaatcagcctggcacaccaaatccagatgcagagataatagcactatcacctaagaccctaatggcaacaaacaggttcgtatgtgaggtatgcaacaaaggttttcaaagggaacaaaacctacagctacacagaagaggacacaatttaccttggaagctaaagcagaagagtacaaaagaagtgaaacgcaaagtttatttgtgccctgagcctacatgtgttcaccatgacccttctcgagcccttggcgatctcactggtattaagaaacattactccagaaaacatggtgagaagaaatataagtgtgaaaaatgttgtaaaaaatatgctgtccagtctgattggaaagctcatactaaaacctgtggtactcgcgaatacaaatgtgattgtggcacccttttctcaaggcgtgatagtttcatcacccacagagccttttgtgatgcattggcacaagaaagtgcgagaaatccaccaagtttgagcagcattgggagtcatttatatgggagtagcaacaacatgagtt

SEQ ID NO: 6916 - DNA, 710 bp, Artificial
  Synthetic
gttctttttagttgcgaaaaaaaactaaaccttgtttgtttgggtgatgccaaagtaaaggaagaagaaactaaatcagaaagagtatagggaatagaagtttttgaggttcaaacaactacaaaaagaaacaagatttttgcctctattcatgtctatttccttcacttagctagctactttagcttgttctagttaggtttggttttgtctttagatcctcccaatctctcctttgttttagttttaagcaaaaaagcttttgattctatagctaggtaactagatgatgaatattcaacaaaagcaccaacatgttcatatagtggaggaaaacatgtccaatttaacttctgcatctggtgaagcaagtttatcttcttctaacaacatgaatgatactactactggagccattttcattcctcataatcaaaatccaccccagcaacaaatcaagaaaaagagaaaccaagctggcaatccagatcctgaagcagaagtgatagttttgtcaccaaagacactactggcaaccaatagattcttttgtgaaatctgtaacaaaggttttaaaagagatcagaatctgcaactccacagaagaggacacaatttgccatggaagctgaagcaaagaacaaataaagaagtgattagaaagaaggtttatgtttgtccagagcccagttgtgtgcaccatgattcct

SEQ ID NO: 6917 - DNA, 651 bp, Artificial
  Synthetic
ttcttttcacttctctcagctagggtttgagacatagctaaatatatataaagtagattatctctttttttaatgcaatgattaagggcatggtaggagatgatagtatgtcaaatttaacatctgcatctaatgaagcaagcatatcttcaagtaatagagctgaaattggtagtactctctacccacagcatcttgcaccaacaaacattcaaacacaaccagctgctaataagaagaagagaaatctaccaggcaatccagatccagaagcagaagtgatagctttatctccaaaaagtctattggcaacaaatagatttgtatgtgagatctgtaacaaaggatttcaaagagatcaaaatcttcaactacacagaagaggtcataatttgccatggaaactaaagcaaagaacaaacaaggaagtgaagaagaaagtatatgtgtgtccagagccttcatgtgtacaccatcatccttcaagggcactaggggatttgactggaattaagaagcatttttgtagaaaacatggtgagaagaaatggaagtgtgataaatgttcaaagagatatgcagttcagtctgattggaaagctcattccaagatttgtggtactagagagtatagatgtgattgtggaaccc

SEQ ID NO: 6918 - DNA, 716 bp, Artificial
  Synthetic
ttatcaggggtatgacggccagccagatgaatcaaacagcatcggattgttgggtggagcgtaaacttgattccctccggtgatttgatttgcgttcatattctccgttcttggatgagctaccaccaccgatgaaatctccaccgtgtcttcctcaccggaaactttgatggtcccggcagagatttgcttcttgatcaaaccctggtctcttagtaaagctctcagcttcttcacctcatcgtgtaacatttgtttctccctagaaacgacgtcgtactcttgtctaagcgagtcgtacaactgctcaagctgcttcgccttccaccgtgcacggcggttttggaaccaaactgctatctgacgtggctgcagaccgagctctctcgacagcttcaccttcctgtctgaatctaatttgatctcttcttgaaaacttcgctcaagtgaagctaattgtccactcgttagtctcttcttttttatcatctcattgttgttgttcggaaatcggtacgcattcatgatcttttctgattccggtacagagataaccggtccggtttgtgtatcgccaggcgtatatgaatttcctgcgtaaggatcaaagttgaagctgtggagcgagttaaaggaactagactccggccatggcggtggcatgaaagctactctcacgttttatacgttgctcgttgttgaccactccatgctgc

SEQ ID NO: 6919 - DNA, 364 bp, Artificial
  Synthetic
ttcgatgatgaagatggagaactcctcaaagaagcgacctttctttagctcgccggaggaactatatgacgaggaatattacgacgagcagtcgccggagaagaaacgccgtctcactcccgagcaggtgcacttgctggagaagagctttgagacggagaacaagctggagccagagcgtaagactcagctagccaagaagcttggcctgcagcccaggcaggtggctgtgtggttccaaaaccgccgtgcccggtggaagaccaagacgcttgaaagagattatgatcagctcaaatcctcttatgactctcttctctctgattttgactccatgcgcaaagataatgagaagctcaaagct

SEQ ID NO: 6920 - DNA, 379 bp, Artificial
  Synthetic
tttctttttctccttttgtccgtacgcgttttcttaccggtgacctgaaagtctcaaaaaatggcggcgtatagagctgacgatgattacgatttcctctacaaggtggtattaatcggtgattccggcgtcggtaaatccaatctgctttctcgattcacgcgcaacgagttcagcctcgagtctaaatccaccatcggtgtcgaattcgccacccgaagcattcatgtcgatgaaaaaatcgtcaaggctcagatttgggacaccgccggccaagagagataccgagcaatcacaagcgcatactatcgaggagctgttggggctttgcttgtttatgatgttacacggcatgtgacatttgagaacgttgagagat

SEQ ID NO: 6921 - DNA, 472 bp, Artificial
  Synthetic
cccacgcgtccgctacaattcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatatt

SEQ ID NO: 6922 - DNA, 439 bp, Artificial
  Synthetic
tctgattctttcgcctctgtcgagaatcatcataaatggcggcggccggctctaccaatctgcaagctaaattggtgcttctaggcgatatgggagcgggaaaatccagcctagttttgcggtttgtgaaagaccagtttcacgaataccaggagtcaacaattggtgcagctttcttttcgcaaactttaactgtggatagcacaactgtgaagtttgaaatttgggatacagcaggtcaggaaaggtatcacagcttggcacctatgtattaccggggagctgctgcagctattataggatatgacatcacaaatcttgattcatttactcgagcaaagaagtgggtacaagagcttcaaaagcaaggtaaccaaaatctggtcatgggcctcgctggaaacaagggcgatctaacatccaaaagaaaagttgaatc

SEQ ID NO: 6923 - DNA, 853 bp, Artificial
  Synthetic
tccgatcccgtatggttggagatattccccttcatcattttttcctgagaaaattcaaatggccgttccacccgctagagctcgagccgattatgattacctaatcaagctcctcttgatcggcgacagcggtgtgggtaagagttgccttcttttacgtttctcagatggctccttcacgaccagttttattacaactattggcattgacttcaagataaggaccatagagcttgatagcaaacgaatcaaactacaaatctgggatactgctggtcaggagcggttccgaacaattacaactgcttactaccgtggagccatgggtatattgctggtgtatgacgtgactgatgagtcatcttttaacaacatcaggaactggataagaaacattgagcagcatgcttccgacaatgtcaacaaaattctggtcggcaacaaggctgacatggacgaaagcaaaagggctgttcctacatcaaaaggtcaagcactagccgacgaatatggcattaaattctttgagacaagtgccaagacaaatatgaatgtggaggaggttttcttttccatagctcgggatataaagcaaagacttgctgaatctgactcaaaggctgagcctcagactatcaggataaatcaaccagaccaggcagcaggagctggtcaaagcgctcaaaaatcagcttgctgtggctcttgaaaaattgacggcaagaaagacaggatgatggggaatacatccttaaagttaccattttagtgggaagggtggaactaatctttgttataacattctcaccatcgattgtatttttctctttacagttattttcttcaatatcta

SEQ ID NO: 6924 - DNA, 651 bp, Artificial
  Synthetic
gatcgaagccccaaaaacatgcgcagaaaaggtcggttgtccagataagggagtagtacatattatgctcaataacaactactgggcatcaatcatcaattctactggaaacgtctaaaattgccaactgtctgtcttcctcacgccacacacacacacacataccggcgcggagttttctgaatttagtctcgttttgtcagatcgaagtccgccgaagatgccttcacgccggcgaactcttttgaaagtcatcatcctcggtgatagcggggttgggaagacctcgttgatgaatcaatatgtaaataagaagttcagcaaccagtacaaagcaactattggggctgatttcttgacaaaggaagtgcagtttgaagatcggctctttacattacagatttgggacacagctggccaagagagatttcaaagtcttggtgttgcgttctaccgtggtgctgattgctgcgtccttgtgtatgatgtaaattcaatgaagtcatttgaaaacttaaacaattggagagaagagtttctaattcaggcaagcccatcggatccagaaaactttccatttgttgtgctggggaacaaagttgatgttgatggtggaaatagtagagtggtgtcggagaaaaaagctcgggc

SEQ ID NO: 6925 - DNA, 458 bp, Artificial
  Synthetic
gttggaaagtcatgtcttctcctgagatttgctgatgattcttatttggacagttacatcagcacaattggtgttgacttcaaaatacgcactgtggagcaagatgggaagacaatgaaacttcaaatttgggacactgctggacaagaacgcttcaggacgattaccagtagttactaccgtggggcacatggcatcattatagtttatgatgtaactgaccaagaaagctttaacaatgttaagcaatggttgagtgagattgatcgttatgcaagtgacaatgtaaacaagcttctggttgggaataagtgtgacctggctgacaaccgtgctgtgtcttatgatacagcaaaggcttttgctgatgaaattggtattccattcatggagactagtgcaaagaatgccacttatgttgagcaggccttcatggcaatggcagctgacataaagaa

SEQ ID NO: 6926 - DNA, 663 bp, Artificial
  Synthetic
tcttttatttacagaaaaacagcataagtgttctcctctcacggcctcaaaaactccgaacagtcgaaagaaacacacaaagacaaaatcctccggggaaaaagaatatgagcaacgaatatgattacttgttcaaactattgctaatcggagattcttctgttggcaaatcttgtcttcttctcagattcgctgatgattcgtacgttgaaagttacataagcacaattggggttgatttcaaaattaggaccgtggagctggatggaaagacaatcaagctgcaaatttgggatactgctgggcaggaacggttccggactataacaagcagttactatcgtggagcacatgggattattattgtttatgatgtaactgaaaaggagagcttcgacaatgtcaagcaatggctgagtgaaattgatagatatgcaaatgaaagtgtttgcaagcttctggttggaaacaaatgtgatttggtagaaaataaggttgtggacacacagacagcaaaggcatttgcagatgagttaggtatccctttcattgagacaagtgcaaaagattccattaatgtggagcaggctttcttgacgatggctggagagattaagaaaaaaatgggtagccaacctgctggagcaaagaactcaggtggcg

SEQ ID NO: 6927 - DNA, 529 bp, Artificial
  Synthetic
atttggtgcaaagccaatcttgggtatttttgtgtgtagaggcaggcatttgttggtttacaacatgaaccaagaaatgagtggcgttatagttgcggatcagaagcagcagcaagaaatgaaaggtgtgaatgggggtgttcatgaggatattaagattgactacgtgtttaaggttgtggtaattggggactctgctgtcggtaaaactcaggtgctgtccaggtttgccaagaatgagttctgttttgactccaaatctaccattggtgtggagtttcagactaggactgtctccattcagtccaaaatcatcaaagcccagatctgggacactgctggccaagaaaggtacagagcagtgacaagtgcatattatagaggagcactaggagctatgttagtttacgacataacaaagagacagagctttgatcatgtagctagatgggttgatgaactcagggctcatgccgatagttccattgtgatcacgttgatcggtaacaaagctgatctagtcgacttg

SEQ ID NO: 6928 - DNA, 653 bp, Artificial
  Synthetic
cccacgcgtccgcaactttctctctgtatacgtcctaatctggggcgacccttttcactccggtcagtttcccgccgggaaatctttaattcttgttgtattgacagcttccttgcttgtaccttcatctcgctttaccgatcttgcactttacagtaatcatcatgaatcccgaatacgactatcttttcaagcttttgcttattggagattctggtgttggcaaatcatgtctcctcttgagatttgctgatgattcatatcttgagagttacattagtaccattggtgtggactttaaaatccgcacagtcgagcaggatgggaaaaccattaaacttcaaatttgggatactgctggtcaagaacgttttaggacaattaccagcagctactatcgcggtgctcacggcataattgttgtctatgatgtaactgatcaagagagcttcaataatgtcaagcaatggttgagtgaaattgatcgatatgcaagtgataatgtgaacaagcttcttgtcggaaacaagtgcgatctcacagcgcagaaggtagtttccacagagacagctcaggcttttgctgatgagatcggcattcctttcatggaaactagtgcgaaaaatgccaccaatgtggaacaggctttcatg

SEQ ID NO: 6929 - DNA, 715 bp, Artificial
  Synthetic
gaattcgaagaccggatgaagagtatgattatctattcaagatcgttttaattggtgattcaggtgttggtaaatccaatcttctctcccgtttcactcgtaatgagttttgtttggaatctaaatctaccattggagttgaattcgctactcgtactcttcaggttgaaggcaagacaatcaaagcacaaatatgggatacagctgggcaagagcgatacagagcaattaccagtgcctattacagaggtgcactaggtgctcttctagtctatgatgtgacaaaaccaacaacatttgagaatgtaactcggtggctcaaggaactgcgtgatcatgctgactccaacattgtgataatgctcattggaaacaaaactgatctgaagcacctccgtgcagttgcaacagaagatgctcagagttttgctgagaaggaagggctttcattcatcgagacctctgcccttgaagcaataaatgttgagaaggctttccaaacaatccttggagagatatatcgtataattagtaagaaatcccttgcgtcagaggagtctgcaccgtctagcattaaggaaggccaaacaattgatgtctcaggatcagatggcaattcaaagaaatcatgctgttctacttaaggggtgatttcttccattctttatcctttctggtgactaatgttctataggtctcaagtctttcaactatg

SEQ ID NO: 6930 - DNA, 744 bp, Artificial
  Synthetic
gtcaattaggtcttttggatcagggagctcgtccgcgatgtcgtatgcctatctcttcaagtacatcatcatcggcgacacgggtgtagggaaatcgtgcctgctgctccagttcacggacaagcgattccagccggtccacgacttgacgattggcgtcgagtttggggcgcggatgatcacaatcgataacaagcccatcaagctccaaatctgggacacagcaggccaagagtctttcagatcgatcacgaggtcgtactaccgcggtgccgccggtgccttgcttgtgtacgacattaccaggcgagagactttcagtcatctggcaagctggctggacgacgctcggcagcacgcgaactccaacatgacgatcatgctcattggtaacaaggccgatctggctcacaggcgagcagtgagcacggaagaaggcgagcaattcgccaaggaacacgggctcatcttcatggagacgtcggccaagaccgctcaaaacgtcgaggaggctttcattaacacagcatcgaagatccaccagaagattgaagaaggcgtgttcgacgtttcaaacgaggcgtcgggaatcaagatcggagttctaccaaataatccccacagaggtgattacccgggtcctcaaggtggtggctgctgcagctagaaggcgggtataagttctcattaaaaaatgatttaccatgtcgtgaataattttccctcctgtacaaagctatcgtg

SEQ ID NO: 6931 - DNA, 942 bp, Artificial
  Synthetic
agaatgaacctgtttgcgaatccacgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattttcgctggtttttcttgatctcttcctcggttctgcgaagaagacgcatcggcagcaatgaatcccgagtatgactatctcttcaaactcctcctaattggcgattctggcgtcgggaaatcgtgcctgctgctacgattcgcggatgattcgtaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcagactgccaaggcttttgcagacgagataggaatcccgtttctagaaaccagtgccaagaacgcgaccaacgtagagcaggcattcatgaccatggctgcggagatcaagaacaggatggcaagccaaccagcgatgagcaacaagccgaccaacgtgaatatcaacaaggggcaacctctcaaccagaagaatggctgctgctaggaggaggaagcaaaagaagcacaagatttacgtagatgatgctgcgatgaatggtcgatcgttgtttcaattttttctttttcttctctccagtggatattttttagtactc

SEQ ID NO: 6932 - DNA, 512 bp, Artificial
  Synthetic
gaattcaacgagccccagccagccttctcgatctgagactttttagacagacagattgcgaatccattatttctggtggtgatctgaaaccaatcactcggattactagatggcagcagctccggcacgtgctagggctgattatgattacctgattaaacttcttctcattggtgacagcggagtcgggaaaagttgcctgctattgcgttttcctgatgattcttttacaactagttttattacgacaatagggattgacttcaagattaggaccatcgaacttgatgggaagcgaatcaaacttcaaatatgggatacagctggtccaaaacgtttccgcactattactacagcatactacaggggaaccacgggtattcttctggtgtatgatgtcacagatgaatcttcattcaacaatatcccgaactggataataaacattgaacagcacgcatctgacaatgtaaacaaaatactggtggggaacaaagctgatatggatgaaa

SEQ ID NO: 6933 - DNA, 770 bp, Artificial
  Synthetic
gcagcatggacgaggctaccggagaaacagaaactcaagatttcatgaacgtcgaatccttctctcagcttcctttcattcgccgtcctaaagataagaaccctaaacccattcgtgtcttcggaagagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattatacacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaataa

SEQ ID NO: 6934 - DNA, 959 bp, Artificial
  Synthetic
gcagcatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgccggttataaaagcaagaagaagaatcgtcgccggttttggtgttcccggatccgtatctgttaccggatttatctctcgccgccgaatgtttttggcataccgacattgcccctgaccttttgtttctccgatgaagaaaccggatcacaatcaactttgttaccatacacagaggtttcgatacaaggagaaacccaaactgcagatttcgagtttggtttgattgatgatcttcgagtcttccccatgggatgtggatcatttcttcgaccatcatcatcactctttcgattaataa

SEQ ID NO: 6935 - DNA, 695 bp, Artificial
  Synthetic
gaacctcgcgctctgcctcctcatgctcgcccgcggcggccaccaccgcgtccaggcgccgcctccgctctcggcttcggcgcccccgccggcaggtgcggagttcaagtgctccgtctgcggcaagtccttcagctcctaccaggcgctcggcggccacaagacgagccaccgggtcaagctgccgactccgcccgcagctcccgtcttggctcccgcccccgtcgccgccttgctgccttccgccgaggaccgcgagccagccacgtcatccaccgccgcgtcctccgacggcatgaccaacagagtccacaggtgttccatctgccagaaggagttccccaccgggcaggcgctcggcgggcacaagaggaagcactacgacggtggcgtaggcgccggcgccggcgcatcttcaaccgagctcctggccacggtggccgccgagtccgaggtgggaagctccggcaacggccagtccgccacccgggcgttcgacctcaacctcccggccgtgccggagttcgtgtggcggccgtgctccaagggcaagaagatgtgggacgaggaggaggaggtccagagccccctcgccttcaagaagccccggcttctcaccgcgtaattcagcagctgcacggatccgatccgtcagagtttttgtctaaggagtgaaattcagtcgaaacacacta

SEQ ID NO: 6936 - DNA, 875 bp, Artificial
  Synthetic
ccacaccacacagcaaccagccagctgccacactagcttgaggcgagcgagcgaagcttagctagcggatataacaagtcgtcgatctgcttgctgcttttgtgaattgcggtggaagcatgtcgagcgcgtcgtccatggaagcgctccacgccgcggtgctcaaggaggagcagcagcagcacgaggtggaggaggcgacggtcgtgacgagcagcagcgccacgagcggggaggagggcggacacctgccgcaggggtgggcgaagcggaagcggtcgcgccgccagcgatcggaggaggagaacctcgcgctctgcctcctcatgctcgcccgcggcggccaccaccgcgtccaggcgccgcctccgctctcggcttcggcgcccccgccggcaggtgcggagttcaagtgctccgtctgcggcaagtccttcagctcctaccaggcgctcggcggccacaagacgagccaccgggtcaagctgccgactccgcccgcagctcccgtcttggctcccgcccccgtcgccgccttgctgccttccgccgaggaccgcgagccagccacgtcatccaccgccgcgtcctccgacggcatgaccaacagagtccacaggtgttccatctgccagaaggagttccccaccgggcaggcgctcggcgggcacaagaggaagcactacgacggtggcgtaggcgccggcgccggcgcatcttcaaccgagctcctggccacggtggccgccgagtccgaggtgggaagctccggcaacggccagtccgccacccgggcgttcgacctcaacctcccggccgtgccggagttcgtgtggcggccgtgctccaagggcaagaagatgtgggacgaggag

SEQ ID NO: 6937 - DNA, 743 bp, Artificial
  Synthetic
cccacgcgtccgcctttgggcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgat

SEQ ID NO: 6938 - DNA, 647 bp, Artificial; identical to SEQ ID NO: 4618
  Synthetic

SEQ ID NO: 6939 - DNA, 476 bp, Artificial
  Synthetic
cccgcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggaaatggggcaagaggtcttcctactgaagaggcaatgcgtggttcatcagcgtactcctgccctaggtgccctgctgttatagcatcaaatcaaattcatatatagatcaaatcaaatcttcttctcttcc

SEQ ID NO: 6940 - DNA, 363 bp, Artificial
  Synthetic
cccacgcgtccgctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccacc

SEQ ID NO: 6941 - DNA, 554 bp, Artificial
  Synthetic
ggctacagcccttcactgcgcaattgctggtgactctggtgctttgcttgaggttgtcaagctcttgcttgatgcttctgctgatgtgaatttggttgatgcaaagggaaaacgggctgttgacctgatctcagctcagggctgttgtctcaactctaggaggaagatactggagcacttgcttggaggaagcagcgacgacggggaagcaagtggactcatcgatcagattatctctgaacaagcagaagaacagctgttattgactccaaacatctctaaatttgggagcgagaagaaagagtatcctgttgatccctctcttccagacataaagattgggatatatgggacagatgacttcagaatgtacatatttaaggtgaaaccatgctcaagagcttactcccatgactggacagagtgcccctttgtacaccctggtgaaaacgccagaaggcgtgaccctagaaaataccactatagttgtgtcccttgtccagattttcgcaaggggacatgccagcgaggagacgcttgtgagtatgcgcatg

SEQ ID NO: 6942 - DNA, 863 bp, Artificial
  Synthetic
gcagcatgaacaacaatcattcctatgatgatcgcagttttcacatgccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcttgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatccttacgttttcagggcatcataagtgtaatatctgttttagagtgttctcgagtggtcaagctttaggaggtcacatgagatgtcattgggaaaaggaggaggagccgatgatcagtggtgctttggatttgaatgttcctccaacaatacaggatctttctacttcggacacatcagggtgttgtttagatcttaggttaggactctaataa

SEQ ID NO: 6943 - DNA, 661 bp, Artificial; identical to SEQ ID NO: 4610
  Synthetic

SEQ ID NO: 6944 - DNA, 610 bp, Artificial
  Synthetic
ggcgcgcaaggtccggagaagtagggagctgtgaaagaaggcgaggaagaaaaaagagaattttattttttgttcgtggttggatcatcttgctctcgagatatttgacgtagagcaagctttgtctttcattgctttgatcgttgtatagctttttggttttgagaggaagagatgggaaggtcaatggatcctttggttcttggacgagtgattggagatgtgttggatatgtttgtcccggctgtggacatgagtgtttgctacggaagcaagcaagtcaacaatggttgcgagctcaagccgtcggcgactcaagcccgaccaaccgtccaagttgtatctcctcacgaagaaggcgctctctacaccttggtgatggtcgatcccgatgctccaagtcccagcgagccgtccatgagagaatgggtgcactggatcgtcgccgatatcccctctggtgcggatgcgagccaaggaagggagatcctccagtacatcggcccgaagccaccgactggaatccacagatacgtcttcgttctgttccggcaaatgggaccagtcctcatgctcccgccgctgatgaggaacaacttcagcacccgct

SEQ ID NO: 6945 - DNA, 579 bp, Artificial
  Synthetic
gcagcatgacaaagctccccaacatgacgacaacactcaaccatctatttgatctgccggggcagatttgccatgtccagtgtggtttttgcaccactattttgctggtgagtgtaccgtttacaagcttgtcaatggtggtgactgtgagatgtgggcattgcacaagccttctctctgtcaatttgatgaaggcttccttcattcctctccatctccttgcttctctctcccatcttgatgagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaaccacctgagaagcgacaaagagctccttcagcttacaattgcttcatcaaggaagagatcaggaggttaaaggctcagaatccaagcatggctcacaaggaagctttcagcttagctgccaaaaattgggcccattttcctccagctcacaacaagagagctgcttcagatcaatgtttttgtg

SEQ ID NO: 6946 - DNA, 708 bp, Artificial
  Synthetic
agggttttcatctctctttcatttctggcctttttcttgcagcaatttttgcgctttgttttcacaactcaaatcatcaagaagaaagcagatccaaggagggggtgggtagtttagtttagtagttgaaactatcaaaacatcaatcaatcaaatcaatcaaatcaatcaaacagaagcaacagctaatatcagtttgcaaaatagtaggaaatagagtatcatgtcctcttcaactcctaattctactttgtcattggaccacttacctccttccgagcagctctgctatgctcattgcaacatctgtgacactgtcctcgcggtaagtgttccgtgcacaagtttgttcaagactgtaacggttcgatgtggccactgctctaatcttttgccaggattgcttttgccttcagctaaccatcattttggtcacacttacttctctcctgcccacaatcttctggaagaaattaccagcacaaccccaaatttcttgatgaatcagagtaactctactgattttgttatacctactcgacctggatttgatgatcttcctagaccacccgtcattaacagacctcctgagaagagacagcgagtcccctctgcttacaaccgattcatcaaggaagagatccaacgcataaaagcagggaatcctgacattagccacagagaagctttcagcgccgctgcaaaaaa

SEQ ID NO: 6947 - DNA, 693 bp, Artificial
  Synthetic
tcaggggaacaactctgttatggccaatgcaacttttgtgatactgttctcgcggtgagtgttccttgctccagtttgttcaagactgtgacagtaagatgtggtcattgcaccaaccttctgtctgtcaacgtcaacatgcgtggcctgcttcttccctctgctaatcaacttcatctcccccattctttcttttctcctcagaatcttctggaggagattcggaattgtccaccaagtttgttaatcaatcagccaaacccgaatgagtcactcatgccagttccaggagttgatgaacttccaaagccaccagttgcaaacagacccccggagaaacgacagcgtgtgccatctgcttacaatcgattcatcaaggacgagatccaacgtatcaaagctggaaatcctgatataagtcacagggaggccttcagtgctgctgcaaagaattgggcccactttccacacattcatttcggacttatgcctgatcaaccagtgaagaaacccaatgcatgtcaacaggaaggggaggatgttctgttgaaggaagggtttcttgctccagcaaacgtgggtgtatctccttactaattaaggaaatgaagtcaccagccaatgttctctccctgatctgttggaactgtctatttgtctaattaatgtgcgttagtttatctacagtttaga

SEQ ID NO: 6948 - DNA, 630 bp, Artificial
  Synthetic
ggaaaaaaagggagaggggctctctctttctctctactttccttcacccaaacagaccacaaacagtagagagagaagctgtgtttttagagagagaaagttagagcttctgaatcctaatctcttccatggctgtattctagtcctctctttatatcccttgatatttattttcatctccaaaaagaaaaaatctttttttttgaaccattgggccgaccatgcggagagctagagcagcggcggcaccggcaccggtgaccggagaaccaaatggatctggaggatctaaagagataaggtttcgtggagtccgaaaaagaccatggggtagatttgcggcggagatcagagacccttggaagaaaactagggtttggttaggtactttcgattctgctgaggatgccgcgcgtgcttatgacgccgcagcgcgtgcacttcgcggtcctaaagccaaaactaatttccctttaccttatgctcatcatcaccacttcaatcaagggcttaaccctagtaacgatccgtttgtggattcccgattttaccctcaggataatccgattatttcgcagagacctacctcgagctcaatgagtagtacggtggagtccttcagtggacctc

SEQ ID NO: 6949 - DNA, 594 bp, Artificial
  Synthetic
attagttcatcaaatttcagcataatttgcccaaaattattactattacaaaaataacataggcggaaagcgtaaatggcgccgaagcaacagggtggcgcggtagcggtggaggttacggcggcggttggaaaagtgaacgaaatttcaaaagaggtgcattataggggcgtaagaaagaggccatgggggaggtatgcggcggagataagagatccggggaaaaagagccgggtttggcttgggacttttgatacggcggaggaagcagctaaagcctacgatgcggcggcgagagaatttcgcggtgcaaaggcgaaaactaattttcctccggaggaagaagagaacctcaaaatcgcccaaaacaatttaggcgttaagatgaatacaaatgttaatgataataacaatcgtagtccgagtcagagcagtaccgttgagtcatctagccgtgacggtttatctcctgccgttatggttgactcatctccgttagatctcagcctcggcgtgaaattcccgttccagaacaatcagttccgtacttctccgatttccgtcgggttctccggctgcggattcaccggcgca

SEQ ID NO: 6950 - DNA, 686 bp, Artificial
  Synthetic
gaattcagaggaagaggatctacagctgcagctgaagtggtgatgatggtaggaggaaatgaaatgttaaatcaagaagaagaagtgaaagaaatgagatatagaggtgttagaaaaagaccatggggaagatttgcagcagaaattagagatccatggaagaaaactagagtctggttaggtacttttgattcagctgaggatgctgctaaagcttacgacactgctgctcgtaatctgaggggtcctaaagctaaaaccaatttcccatcttcacccattcacccacatcaaacaatttatcatcaacaacaacagcacagcaccaatttttataataatcagcaatacggtcagcgaaatcacaatcaaactcaagttaatgatattcagagaccaactagtagtagtttaagtagtactgttgaatcgtttagtggtccgagattttcttcttcagccttgatttatcatgcatcatctcagcagcagcagcatagaagacggcggcctgatcgacaaccacttgatcctgatcaagattgtcatagtgattgtgactcttcttcatctgtgattgatggtgataatcatcatgatatcactgcagcttctagttcatcttctgctcttaatatcaagagcaaacaaccattatcgtttgatcttaactttcctcctcctat

SEQ ID NO: 6951 - DNA, 505 bp, Artificial
  Synthetic
cccagacgccacacacacccaaacccaacctcccaaaacacccacccggtttaccagagatccgcgcccgccacttgtaaacctggtgcacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcgg

SEQ ID NO: 6952 - DNA, 639 bp, Artificial
  Synthetic
ggtttctctcgcatcgatgctcggtgaggaaatccggcaaggcgagggcgatagtggatcatcgtcgggagctgcggctgcagcggcagcggcggcggcagcggcggcattgccgtggtgggctcccacggccgccccaaagaccgtgtttgatggttgcgatagtgtaaactttgctagcacaatgcagccatcgcaagctccacaggatgtttcgtcttctccagtccaaaagatacaagtgccaccttctggaacagctgtggatgacactgctgcaactggtgaggtagcgaatggaataccaccgccgccgggagagtatatcattcggccaccacatctagagctcggtcaccccatggttcgcgctggtttcccgtatgatccatactacggtggacttgttgcggcttatggagctcaggcaatgccgatgatgcatcctcatgttctaggcatgcaacacagccggatgccgctgccgtcggagatgatggaagaagagcccgtgtatgtaaatgcgaagcagtaccacggtattcttcgcaggaggcagatccgagcaaaggccgagctcgaaaacaagcttgtcaagaccaggaaaacttatctacatgaatcgcgacaccagcacgc

SEQ ID NO: 6953 - DNA, 717 bp, Artificial
  Synthetic
agaggatagagagagagtttgaaggaaggagacatgcttgatttcaacccaacgagaaacagcacttgtgtttatttcttactatcttattaactttacctgattccacagaagtggaatttccgtctccttgttatcacgagatgaagtctttagatccagacttacaaggcgagacattgcggttgacacattctattattaattcccaagacgaaatgactacctcggagaaaacaaattctcaagatcaatgtgcctcctcagaatatgttcatgatgaaagatatgggagagatatgcaagctcaaataaagcctgctcgtttttcgttgcagaatgaagtggcccattcaactggtttctctccttttggttactctgatccctatatgagtggcttgtatactgcttatggacctcaagcttttccacaaatgatggggatagcgcctacccgcgtcccactccccctagatcttgcagaggatggaccaatttatgtaaatgcaaaacagtaccatgggatcatgaggcggagacagatacgtgctaagcttgaggctcagaacaaacttgtcaaaaatagaaagccatatcttcatgagtcacggcatcttcatgcagtgaatagagttagagggtccggaggacgttttcttagctcaaagaaagtcaatcaatctgatccaaatagtcaccctactaactcaactt

SEQ ID NO: 6954 - DNA, 734 bp, Artificial
  Synthetic
gcagcatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagaccagccccagagaagcgacaaagagtaccatctgcatacaaccgattcatcaaagaggagatccaacgtataaaggcaggcaaccctgatatcagccacagagaggccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagtaa

SEQ ID NO: 6955 - DNA, 68 bp, Artificial
  Synthetic
gcagcatgtctgtaaatttctcatctgaacgtgtttgctatgtccactgcaccttctgctccacgatt

SEQ ID NO: 6956 - DNA, 591 bp, Artificial
  Synthetic
cccccccccgaaagagagaataaataggaacctttttctctttagtattatctaaaaagttctatatatttgttgttgttccttcttcttccttcttgaatttaccccttcactcattatttcttcaacttcttctttttctttacttagcaacaaaaattttccattaaaatggcaagctgcatcgatgttgcttctgaaaaactttgctatatcccttgcaacttttgcaatattgttcttgcggtgagtgtaccatgcaacagcctatttgatattgtgacagttcgatgtggtcactgcacaaatctgtggtccgtgaatatggcagctgcctttcactcttcttcttcttcttcctcttggcaagacattcatcatcttcaggtgccaaactacactgctcctgagtacagaatggattttggttcatcaaccaaatgcaacaacaggatgacaatgagaacaccaatcacaaacaacactcacgaggagaggattgtgaatcgacctcccgagaagaggcagcgagtaccttctgcatataatcagttcataaaagaagagattcagaggatcaaggctaataat

SEQ ID NO: 6957 - DNA, 681 bp, Artificial
  Synthetic
acatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccggcgccgccgggcagcagcagcagca

SEQ ID NO: 6958 - DNA, 619 bp, Artificial
  Synthetic
aagaaattattgttatagtgtgtgtaaatgtatataggattgaagagatgtggaaagagttgtagattgagatgggctaattacttaagacccgacattaagagaggagagtttagtcctgaagaagacgacactatcatcaagcttcatgctcttaagggtaacaagtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgata

SEQ ID NO: 6959 - DNA, 595 bp, Artificial
  Synthetic
gcagcatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctataaaacggttcaagaatcgcagccggttctga

SEQ ID NO: 6960 - DNA, 466 bp, Artificial
  Synthetic
gcagcatgatgtcatgtgggggaagaagccagtgtctaagaaaacaacgccgtgttgcacgaagatggggatgaagagaggaccatggacggtggaggaagacgagattcttgtgagtttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggt

SEQ ID NO: 6961 - DNA, 103 bp, Artificial
  Synthetic
gcagcatggcggatcgtgtcaacggtccatggagtcacaaaaaagatgagcagctactaaggatggttgagaaatactgaccgaggaattggtctgcgattat

SEQ ID NO: 6962 - DNA, 914 bp, Artificial
  Synthetic
gcagcatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagtaa

SEQ ID NO: 6963 - DNA, 656 bp, Artificial
  Synthetic
gcagcatgaactcattttctgccttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaa

SEQ ID NO: 6964 - DNA, 609 bp, Artificial
  Synthetic
atatacctttagatctacgttactataacataaccccataaattgcttcttttatcattttcccaaatctcgagcatgcgagtgttgagggagcagagaagtgaagcatgcaacagaatatgaagaaaagttcaaatagttgtgaagctgctaaacctaaagaaagacatattgtttcttggtctcaagaggaggatgatatactaagagagcaaattcgaatccatggaactgacaattggacgatcatagcatcgaagttcaaggataaaacaacaaggcaatgcagaagaagatggttcacttatttaaactctgatttcaagaaagggggatggtcacctgaagaagatatgcttttatgtgaggctcaaaagatctttggtaacagatggactgaaattgccaaggtggtttcaggcagaactgataacgctgtgaagaatcgattcactacactgtgcaaaaagagagctaaacatgaagctttggctaaagaaaacagcaattcattcgttaacctaaataacaagagggttatatttccagatggtctcaatattgacaacataacagaagctgctgctccttttaaaagctgaggacgag

SEQ ID NO: 6965 - DNA, 574 bp, Artificial
  Synthetic
cgttatttattatgcatcttgactacccctcgacccacgcgtccgcaataatataatataactagggtttctatttttaggtctgaagaaagaatggggagagggaaagtgcaattaaggcgtatagaaaataagattaacaggcaagtaacgttttcaaagaggagaggaggtttagtgaagaaagcgcatgaaatctcagtgctttgtgatgctgaagttgctctgattgttttttctcataagggaaaaatctttgagtactcttctgattcttgtatggaacagattcttgaacgatatgagagatactcatacgcagagagacgtttgcttgcaagtaattctgaatcttcggtgcaggaaaattggagcctggaatatgctaaactcaaggctaagattgatctcctacaaaggaaccacaagcattacatgggagaaaatcttgactcattgaacctaaaagacctgcaaaacttggaacaacaacttgatacttctcttaagcttattcgatcacgaaagaaccaactcatgcatgagtcaatctctatgctacagaaaaagtaca

SEQ ID NO: 6966 - DNA, 620 bp, Artificial
  Synthetic
ggcaacctcttccactacgcctcctcccacaccactatggagcgaatccttgagaagtatgacagacatgagttattatctgaaggaaataatgtgattgaagagttccctgagctggagggaagcatgagctatgaccacatcaagctgaggggcaggattgaagctctaaaaaagagccaaaggaatcttatggggcaggaacttgactcgctgacactgcaagatatccagcagcttgagaaccagatagacacttctctgaataacataagatcaagaaagaacaatctcttgctcaagtcgatcgccgagctccgacagaaggaaaagttgctgatggagaaaaacactattctggagaagaaaattactgaactggagacactgcatacatgcatcagggcgtcacccactaaagctgctgctcctcctgcctgcaatactgctgatgcatttgttcccaacctcaacatctgctgcggcgattccggcgagccggaaaccgtgacggcgccacttggctggaccagcagcaacaatggcttgccatggtggatgctccagtcatcatcgaacggcaagagctagaagatgttcagatgaaatgatccctgcag

SEQ ID NO: 6967 - DNA, 668 bp, Artificial
  Synthetic
gcagcatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatga

SEQ ID NO: 6968 - DNA, 607 bp, Artificial
  Synthetic
gataaggggaagaggaggaagaaggaggaggtgtagggagaaaccggagggacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacggcaagctctacgacctcgccaccaccggaaccatggaggagctgatcgagaggtacaagagtgctagtggcgaacaggccaacgcctgcggcgaccagagaatggacccaaaacaggaggcaatggtgctcaaacaagaaatcaatctactgcagaagggcctgaggtacatctatgggaacagggcaaatgaacacatgactgttg

SEQ ID NO: 6969 - DNA, 514 bp, Artificial
  Synthetic
gcagcatgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttggcggagcaagatgagggtctcacgaggcttgtgaaaatgtgtgggccgaggaactggaatctaatctcccgtggaatcccaggtcgctctggtaaatcttggcgattacgttggtgtaatcagctcgatcctatcctcaaacgaaaacctttctctgatgaagaggagcatatgataatgtctggacaggcggttcttgggaacaaatggtctgtgattgctaaactcttacctgggagaacagattatggcattaagaatcattggaactctaatcttagacgttaaccagcagaacaatggaagattcctctattgatgtctaatacagagatagtatatcaact

SEQ ID NO: 6970 - DNA, 515 bp, Artificial
  Synthetic
gcagcatggctacagctacatatccacctcctcctccatattacagactctacaaggatttctcagaaaacactgattctgctcctgaacctcctcctccgattgaaggcacctacgtctgttttggaggcaactatactactgaagatgttcttccaagcttagaagaacaaggagtgcctcaactttatccaaaagattctaatcttgattacaagaaggaactcaggtcactgaatagagaactacagttacatatattggagcttgctgatgttcttgttgacagaccttctcaatatgcgaagagaattggtgaaatttcttcaatcttcaagaacttgcatcaccttctcaattccttgaggcctcaccaagcgagagcaacgcttattcacattatggaacttcaaattcaacagaggaaacaagctgtggaagacattaaaagaagaagagaagaagcacagcgacttctaaaggatgcttacctcactttagatggtcaatagtaa

SEQ ID NO: 6971 - DNA, 433 bp, Artificial
  Synthetic
ttattgaccatctaaagtgacgaaagcatccttaagaagtccttgtgcttcttctctcctcctcttaatgtcttccacagcttgtttcctctgttgaatttgaagttccataatgtgaataagcgttgctctcgcttggtgaggcctcaaggaattgagaaggtgatgcaagttcttgaagattgaagaaatttcaccaattctcttcgcatattgagaaggtcaagattagaatcttttggataaagttgaggcactccttgttcttctaagcttggaagaacatcttcagtagtatagttgcctccaaaacagacgtaggtgccttcaatcggaggaggaggttcaggagcagaatcagtgttttctgagaaatccttgtagagtctgtaatatggaggaggaggtggatatgtagctgtagccatgctgc

SEQ ID NO: 6972 - DNA, 713 bp, Artificial
  Synthetic
  misc_feature (583)..(583): The residue at this position can be any nucleotide.
gtcgagccacgcgtccgaagttcacaacccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaaggccaagaagaagggcgcgcgcgccgacgacttcgaggccgcgttccgcgacttcgacaacgactccgatgacgaggagatgatggtggaggaggcggaggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcgagggcgtccgcgtctggctcggcacgttcgccaccgccgaggccgccgcccacgcctacgacgccgccgcccgcgacctccgcggcgcgaccgccaagctcaacttcccctcctcctcctcctccaccgccgccaccccacgcccccgcaagtgccgccccaccaccgncaccgccacccccaaggcgacgacaccgaacgtcgtcgtcgtcgtcaacctcgtcgacaaagaggccgaggtcagcgagagctccggtgccagcagcagcgcgctgccggacttctcgtggcacggcatg

SEQ ID NO: 6973 - DNA, 647 bp, Artificial
  Synthetic
gcagcatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagactgttagatctagatcttaa

SEQ ID NO: 6974 - DNA, 422 bp, Artificial
  Synthetic
gaaaaaacaaggggaggaaaaggaagagggggaagggagacgccactgccaaaccctagccgagcaccccctcccctcctcctcccccatcggagcctcctcgcctcgccctcgcccaccaagcccccgcgcgcgcgcgcgtgcatccggcgatgcggaagtcgaagcagccgcagccgcagccgtcgccggagatccggtaccggggcgtgcggaagcggccgtcggggaggtacgccgccgagatccgggacccggcgaagaagaccccgatctggctgggtaccttcgactccgccgaggtggcggcccgcgcctacgacgacgccgcccgatctctccgcgggcccaccgcgcggaccaacttccccttggccgcgccgtccgcgcccccgccccggccgccgccgccggcggcggcg

SEQ ID NO: 6975 - DNA, 501 bp, Artificial
  Synthetic
ccccaaactccaacgcaccaccggcgccaaaccaaccacccaccatccaccggtcgaacacttggcgctctcgcccgccttagctcgctctgctcgtggtgctcgacccgaacaagaacggacatggctcccaggaacgccgccgaggccgtcgccgtcgccgtggcggagggcggaggagccggcatggagcccaggttccgcggcgtgaggaagcgcccgtggggcaggtacgcggcggagatccgcgacccggccaggaaggcgcgggtgtggctcggcaccttcgacaccgccgaggccgcggcgcgcgcctacgacagcgccgcgctccacttccgcgggcccaaggccaagaccaacttccccgtcgccttcgcgcacgcccaccaccacgccccgccgccgccgctgcccaaggcggcggcgctggccgtcgtcagcccgaccagcagcacggtcgagtcgtcctcccgggacacgcccgccgccgccccggtg

SEQ ID NO: 6976 - DNA, 677 bp, Artificial
  Synthetic
ttttgaaaaaatggctgtcaaaaataaggttagtaatggcgatatgaaaggaggaaatgtgaaaacaaatggagttaaggaggttcactacagaggtgtaaggaagaggccgtggggtcggtatgcagctgaaatccgtgacccgggtaagaagagtcgggtctggttgggtacttttgacacggcggaagaggcggctaaggcgtacgacactgccgctcgcgagtttcgtggacccaaagcaaaaactaacttccctttaccgacggagaatcagagcccaagtcacagcagcaccgtggagtcctctagcggagagactggtgttcacgcgccgcagaacgcgcccttcgagctggatctcactcgccggcttggctccgttactgctgatggcggtgacaactgtcgccgtgctggtgaagttgggtacccgattttccaccagcaaccgacggtggcggttctgccaaatggccaaccggttttgctctttgattctttgtggcgaccgggagttgttaacaggcctcagccttaccatgtaacgccgatgacgatggggtttaacggcggtaacgccggtgtgggtcctactgtatcagactcatcctcagcggtggaagagaaacaagatgatgagaaaagaggaattgatctggatcttaaccttgctc

SEQ ID NO: 6977 - DNA, 679 bp, Artificial
  Synthetic
aaacagcccctattgctctctcctttctctcacccaaacacaccacaaacagtagagagagaaaaaagctgagttctagagagataaactgagttctagagagagaaagtgagtgctttcggaagggaagctaatcctctggtgcttctcgatctttgattgctctaatcggtatcaaaggggtaggtcttttgttgtttctttcgacttgtggccatgcggagaggtagagcaaccgcggcggcgaagcaagcggcggaggttccaaccgaggctggatctggaggattaaaagagattaggtttcgtggtgtcagaaaacggccgtggggaagatttgcagcggagattacagacccgcggaaaaaaactagggtttggcttggcacttttgattctgctgaagaagccgctaaagcttatgacgctgcagctcggactcttaggggacctaaagccaaaactaatttccctttaccaccgtattctcacttcaatcaaactgtaaaccctaacgacccgtttattgacccgaggttatactcacaggaaagtcacccgattgttattcaaagacctacatcgagcagcatgagtagtaccgtagaatccttcagtggacccaggccggcgccacgtcagcaaacgacggtgttgccttcgagaaaacatccccggt

SEQ ID NO: 6978 - DNA, 693 bp, Artificial
  Synthetic
atttcaccctaccatgccccgttggaaaaattctgagacaaatagatcaacatccgtagcttttcgacaccctaaaaccgacctaaagcgttataggggcgtccgtaaacagccgtggggccggtttgcagccgagatacgagacccgataaaaaaaactcgggtctggcttggcacctttgacacggcggaggatgctgcacgcgcttacgatgatgccgcacgcgccttccatggacccaaagcgaaaactaatttttcagtttttcctccgtatgggcagaaccaatttgaaaatttcaaccgtccggcttccagtagtctgagcagtacgggggagtcatccagtggggcgcgtgattttcactcgcgggttgaacttactcgccggattactccgtcggcggtggagtgttacagtggttgcgattcgtcatcgactgtggtggatgataatattgacggcgattcgtcggcgttttgtaaacagcctctgccgtttgatttgaacttgctccctccgtctgatgacgttgatgatgtccatgttaccccttgtatttttagttattttaattaatttgattatttgatgtatccatgtggtggatgttgaaaaattaataaccaaatgggttttttaaaatatgcattgatcaatttactgagtcatggtgttatctaaatctgaaa

SEQ ID NO: 6979 - DNA, 594 bp, Artificial
  Synthetic
ggaaaatggccacttggctaggacggtggcggttccgacagcgaacggtggagaggtgcgttcagatgaggtgcattataggggtgtgaggaagaggccatgggggaggtacgccgctgagatcagagatcctggccagaaaacacgtgtctggcttgggacttttgatacggcggttgaagctgctaaggcttacgatacggccgcgaggctgattcgtggtaggcgggccataactaatttttctccgacaactgaggataacctcatgaacaatagagatttaatggcaaaacttagtactagaaatcatgttaacattaatataaacaatcacggtcccattcagaacagtgatattgggtcgtcaagcggcggcggtggtacggggaggattcctttggcaaatcagaatcctcagtcgcgccattttccggttactggatgttgtgcttcgctgcagttggcgcgtgataggtactatgtggaggctttaactagagctggagtgatcattaaccgggatacaagtaacccaaagaagacgattgacttcattggctgcggcgttaactgcggcagtgggcgtggggt

SEQ ID NO: 6980 - DNA, 694 bp, Artificial
  Synthetic
ggagagctgtacactatgaccgcctggactccccttctcgtaataacaacttcatgtgtcgattgtttccttcgtcatcgcccgctgcccccaccacggcaacagtggcactagatgcgcccccccccctctctccttcctctcgcaatgcagccgcggtggcggtagaagaagagaaggagattcactaccgaggggtacgaaagcgcccttggggtcgttatgctgctgagatccgtgaccccctcaagaaaacacgtgtctggctgggcacatttgatactgctgaagacgctgctcgtgcctatgacactgctgctcgctcccttcgcggggccaaagcaaagacgaatttcaacccctccgctgctaatagcaacaagagcaagaagataaagagtggtagcgaagcaaagcccccctccttctctcgcccagctttgcaaccaactcaagcacctgcgctaggtttgggtttaagcctacataccccgaatctaccctattactactactattctgcaccaaccatgcctgtcccggcccctcgcacaggaccggtgggtgactcgttgcccttcgaaatcgagaataaaaagagaagcaagaacgaacaagtggaacaacaatcagcaactgattaccacagtggttcatcagatggcgacgatgattaaccagtcatcacatattt

SEQ ID NO: 6981 - DNA, 320 bp, Artificial
  Synthetic
atctgttctctcgcagttttcatcttctcttcttgcctgtttattcgaagtagtaggtatgtctgccaaaggggtggggagtggggggccggaggtgcactaccggggggtcaggaggaggccctggggccgctttgccgcagagattcgcgacccatggaagaagacccgagtctggctcggtaccttcgatactgctgaagaggctgctagtgcttacgataacgctgccagagccctccgtggccccaaggctaaaaccaacttcgcccagagtagtagccttcacctccagcctggctcctgcttccgtcgctccg

SEQ ID NO: 6982 - DNA, 728 bp, Artificial
  Synthetic
aataatgacgttaaacctctgaatagtggcaaggccatcaagaaacgagcagctgaagcttcaataccgaagcaaaaggcattgaaggtgaaggtagtgcagccaccgccggatggcactgtgaggaagttcaggggtgtgcgtcaaaggccgtggggcaaatgggccgctgaaatcagagacccagctcgtcgtgtgaggctctggttgggaacttatgacacagctgaagaagctgccatggtttatgacaatgcagccattaagctccgtgggccagacgctttaacaaatttcatcactcccccaactaagccagaggaggtcaatgtggcttcaaattcgggctatgaatctggcgatgaatcccataatctttcttctcccacctctgttttgcggtttagaacgagtcaatccagtgaagaagctgaacaacaaagtgggtccgaaccaatactcgaagaaactaaaggagatgtatcttgtccattggtggaagaagaagcagttcttgattcgatggacaacagcgagcaaaccgtggaaccccttgagtgccaaggcgagacaagcatgataataccagattattcaaacgactatttgccgacagatgttcccttcttagatgatttcttcaacttcgaagctgcagaacagacattattagacgatacaacaagttttgccaatgatttgtgcacgtcgtacgatgacgtatcgtc

SEQ ID NO: 6983 - DNA, 535 bp, Artificial
  Synthetic
gcagcatggctgtatatgaacaaaccggaccgagcagccgaagaaaaggaaatctagggctcgagcaggtggtttaacggtggctgataggctaaagaagtggaaagagtacaacgagattgttgaagcttcggctgttaaagaaggagagaaaccgaaacgcaaagttcctgcgaaagggtcgaacaaaggttgtatgaagggtaaaggaggaccagataattctcactgtagttttaggggagttagacaaaggatttggggtaaatgggttgcagagattcgagaaccgaaaataggaactagactttggcttggtacttttcctaccgcggaaaaagctgcttccgcttatgatgaagcggctaccgctatgtacggttcattggctcgtcttaacttccctcagtctgtcgggtctgagtttactagtacgtctagtcaatctgaggtgtgtacggttgaaaataaggcggttgtttgtggtgatgtttgtgtgaagcatgaacatactgattgtgaatctaatccattt

SEQ ID NO: 6984 - DNA, 730 bp, Artificial
  Synthetic
tttcttcacccctctgcgttgtctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttg

SEQ ID NO: 6985 - DNA, 660 bp, Artificial
  Synthetic
gaattcaatggaatagatgtttttgatcattgtagtccatcaacagctagtatgtcaagcactgaaattcaacaatgtccaatacccattatggattctaatacctgtgatacatgtggaattagtggttgtttgggttgtaatttctttgatcaagatcaaggaagtaaaaagaaagctaagaaacagagcaacaagaccaacattgtgattgagaagaagaaaaattacagaggagttagacagaggccatgggggaaatgggcagcagaaattagagatcctagaagagcaactagagtttggcttgggactttcactactgctgaagatgcagctagagcctatgataaagctgctattgatttccgtggtcctcgagctaaacttaatttctcattctcagattatgacaatagtacttataactcatcaagtgaacatcagcagcagcagcaagaaatttctcagaaaattgacagtaattatcagcagcaacagattagcaacagcaatgttgagaaaccgaagattgatactgattatcaagtgcaaatgaattttacttcatcacagacagagtcattgatggtaggtccttctactacacttgataagcaattttggggcattgatgaagaaattcacagctggacatca

SEQ ID NO: 6986 - DNA, 657 bp, Artificial
  Synthetic
gcagcatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcaaaaccaagtgaggtagcagagtgtcattcccctccaccatgga

SEQ ID NO: 6987 - DNA, 872 bp, Artificial
  Synthetic
gcagcatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgggtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggcctgggtctggattctccagctggcacgttgaggaccattttcaagatattggggatttattcgggtcggatcctgtcttaactgtttaataa

SEQ ID NO: 6988 - DNA, 665 bp, Artificial
  Synthetic
gcagcatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataataagcggccgcgtcgaggggt

SEQ ID NO: 6989 - DNA, 573 bp, Artificial
  Synthetic
gaaggttgagctgagctcgggagccgtaaagtcgccaggctgccatgtcgtacgcttgagcggcgtcttgagctgtcgcaaacgttcccagccatattcgagttcgcctcctcggttccctgatctcggccacccagcgtccccagctccgttgccggacacctctgtacgtgtagagaccgttctccggaccaccttttcctttggctctcgttctccttcctggtttctgggaagaagaattagaagaagatgaagaagaagatggaggacaagcatttggaacagcggcaggagcagcagccgtctggtttccacaagtatcttccgctcctgcgggctggatcggtgatgtcgatgccatcgctgaaccaaggggtgacttagccatggattgcagtggtggtggactatcagcgaagctgctcgcggattcaaatagagctcaatttctctcagtgacaacggtacgaatatatagaaagtatgggaagcgagaagatctacagattctccgctgctgcttcgggcgtcgagccttgaccgttcacacgcaggctggcttttggttgc

SEQ ID NO: 6990 - DNA, 394 bp, Artificial
  Synthetic
cccacgcgtccgcccacacgtccgggcaacggcactgggggaagtgggtggcggaaatccgcctcccgcggaaccgcacgcggctctggctcggcaccttcgacaccggcgaggaggcggggcttggctacgaccaggcggcgtaccgcctccgcggcgacgcggcgcggctcaacttccccgacaacgccggctcccgcgggccggtccacgcctccgtcgacgccaagctccagacgctctggcagaacatcgccgccgccaagaacgccaagaagtcctctgtctccgcctccggcgccggaacatcctccgcgcccaccagcaactggtcgtcgccgtcctccgacgacgcgtcgtcctgcctggagtccggcgactcgtcgccctccct

SEQ ID NO: 6991 - DNA, 648 bp, Artificial; identical to SEQ ID NO: 4608
  Synthetic

SEQ ID NO: 6992 - DNA, 681 bp, Artificial
  Synthetic
cttggcaacaggtggtccaagattgcttctaatttaccgggacgaactgataatgaaatcaagaatcactggaatacacatattaagaagaagctgaagaaaatggggattgatccagtcacacaccagccaattactgttaaccaaccaaacatagaacagccaacaaaaaatcaaccaattattcaacaagaaaaacaaacaacaatgccaatttccccatctcatgttgtcccagaaataatggatattcttgatcacaacaaggagctggttgaaactcctatattatcaacaatcacagatatcaaattagacgacgacaacaacaataacagcaatatcaacaataataagaatacggggacaagcttctgtactgacgaagtccccgtaattaaaccacatgaaattttattccattctgaatcaaccacttcaacatcatcatcttcttcaccaacatccattattcttgaagatacgcagtttgatttcaattggggagatgatttcagcagaacattggattatttacttaatgatgatattgacatgaataatgtcatttcccaagattggtcaaaggtgttggaagtttgagcaaattttacttgtgattaattttcaaaggggggctgaattaagctttgttcttttgattggcaagtcacttttttc

SEQ ID NO: 6993 - DNA, 607 bp, Artificial
  Synthetic
cttcttcttacttctctctgtagagctctgaggatttactagaataagaaggaaaaaaaaaggaagaagaaattaagaaatgggaagaaaaccatgttgtgtaaaagagggattgagaaaaggtccatggtcttctaaagaagatttattacttactaattatatcaaggaaaatggtgaaggacaatggagatctttgcctaagaatgctgggttgcttaggtgtggaaaaagttgcagactaagatggatgaactatttaagaccagggattaaaagaggaaacttcagccaagatgaagatgatcttataatgagactacattctcttttgggtaattgttggtcactaattgctggaagattaccaggtcgtacagataatgaaatcaagaattattggaatacacatttaatcaagaagcttaaaagtgctggaattgaaccaaaaccccacaaaactttctccaaatgttccaaaactgaatcaagaaaaggaccccaacaagagacatcaagacaaaaacagcgcaaaagaacaacaacaaaaacaataagggtcaaattgtacaagttgagaaaaccaaagtatttgcccccaaaccca

SEQ ID NO: 6994 - DNA, 379 bp, Artificial
  Synthetic
cccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactca

SEQ ID NO: 6995 - DNA, 454 bp, Artificial
  Synthetic
cccccccggagtctgcagcctcggagcagccgcctcccttccaagaacacacaacgcaagaggagcagagcagtccaaatcagagcagggaaggagcaagcacaatggggagggctccgtgctgcgaaaagatggggctcaagaagggtccatggacgccggaggaggacaaggtcctcgtcgcccacatccagcgccacggccacggcaactggcgcgccctgcccaagcaagccgggctgctgcgttgcggcaagagctgccggctccggtggatcaactacctgcggccggacatcaagcggggcaacttctccaaggaggaggaggacaccatcatccatctccacgatctgcttggcaacaggtggtccgcaattgccgccaggttgcccgggaggacggacaacgagatcaacaacgtgtggcacacccacctcaagaagcgcctcga

SEQ ID NO: 6996 - DNA, 537 bp, Artificial
  Synthetic
aggaggaagaagacctcatcattgagctccatgctgtccttgggaacaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaacc

SEQ ID NO: 6997 - DNA, 625 bp, Artificial
  Synthetic
gcagcatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtca

SEQ ID NO: 6998 - DNA, 446 bp, Artificial
  Synthetic
gcagcatgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacaggaagcgattcctcttct

SEQ ID NO: 6999 - DNA, 332 bp, Artificial
  Synthetic
ctctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattg

SEQ ID NO: 7000 - DNA, 486 bp, Artificial
  Synthetic
ccgtctccccgctcgcgtcctcgctctgcgcctcctctccgcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggggtgatgcgttgcagcaagagctgccggctccg

SEQ ID NO: 7001 - DNA, 568 bp, Artificial
  Synthetic
  misc_feature (433)..(433): The residue at this position can be any nucleotide.
ctttttgtttctgggctgtgcctcgttttgtgcttggtttgttcttgcccccccccctttgggatagccatggccttcgttggcaccactcagaagtgtaaggcgtgctccaagactgtctaccctgtcgatcagctcactgctgatggtgcctccttccatcgtgcttgctttcgatgccaccattgcaatggaaccctcaagctcagtaactactcatcatttgagggaacgctctattgcaagcctcatttcaatcagcttttcaagttgacaggcagcttagaaaaaagcttcgagtcaggtaaagcaccgaaacatcacgataggggcattgaaaatgattcgaaggcaccgactagtagggtctcatctctctttgcgggcacacaagataaatgtgcagcatgtgggaaaactgtgtatccattanagaaggtgggtgtagaaggggtatcgtatcacaagtcatgcttcaagtgctgctatggggggtgcactatcagcccttccaactatgtggctcacgagggaaggctatattgcaaacatcatcatacacagctta

SEQ ID NO: 7002 - DNA, 643 bp, Artificial
  Synthetic
tctctctctgaccctcaaaaaacattcttctttcgccattaaactcttcatctgccattacctcgccgcgtctcaaaacttgaactttaatccacacatataatcttacttcagttctagtagatcaatagctgcaacatttttggttcttcttccaatagtcaaatatcagatctagcatatatttttgtgttgaacttgaagttatcagtgatgtcgtttacggggacacaacagaaatgcaaggcatgtgaaaagacagtttacccagttgagcttttgtcagcagatgggattagttatcacaaatcttgctttaaatgcacccattgtaaaggaactctcaagctgagcagttactcctcaatggagggtgttctgtattgcaagccccattttgagcagctctacaaggagtctggcaacttcaacaagaacttccaatcgcctgcgaagtcagctgagaagttaactccagagctgacaagatctcctagcaaagcttccagaatgttttctggaacacaggaaaaatgtgctacctgcggtaaaacggcctatccacttgagaagctgacagtggagaaccaaagttaccacaagtcatgtttcaagtgttctcatggcggatgctctttaaatc

SEQ ID NO: 7003 - DNA, 602 bp, Artificial
  Synthetic
tggtatcaacgcagagtggccattacggccgggggggggatctgagattattcatatatgtaaattatctcaaatctcaattcccaaataatagaacaaacataaaaaataaaaataaaaatcatgtctttttcaggaactcaaacaaaatgcaaggcatgtgataaagctgtgtatgctgcagagcttatatctgcaagtggtgttaattatcataatacttgtttcagatgtagccattgcaatggaagacttgctttgagcaactactctagcctagatggagctttattttgcaagccacattttgaacagcttctcaaggagaaaggaagtgcctcttttaagtccacttcacttgggaggaacagtgacctgagcagaagctctagcaaattgtcctctctattttctggcactcaggaaaaatgtgctgcatgcaagaaaactgtgtacccattggaaaaggtgacagtagatggagaattttaccaccaatcttgcttcaagtgtgcacatggtggatgcaaacttacaacttcatcatatgcagcattagatggacttctctattgtaaacctcatttctctcaattattcaa

SEQ ID NO: 7004 - DNA, 673 bp, Artificial; identical to SEQ ID NO: 4654
  Synthetic

SEQ ID NO: 7005 - DNA, 875 bp, Artificial
  Synthetic
ttttttgatcaaaacacagacaatcaaaagaaactgaacaatgtatttcatcgtaagaaaaaaaagagcaattaacaccaatcaatgtgttaatcaaatatataatcgataccacttatccttttaatttgacttcaagctctgctcttgcacttctccatcgccctcggagcgagaccaatggcatccgatcctttcatgagacgtaaacgcttgcatgtatcgacgaacattggccaaggaacgtcgccgacgagcatccaatcaccgtctttgtcttcataagagggaacatagtcccagctattcaccaaatccatcaatttcctctcattcatgaagtctatcattccttcttctcctccatgtttgcccatggtaaaagagctgaacatgttggacaaagcattagaaagctcatcgtagcttttatacatcctcaaatcgattttcctcaagtacggtgctccgtccattgataccttcacgaacgccgccgcctccgggccaccgcttgatttttggcaggaaaccatcacgttcttccggtatgatctcaccggtggccatcccacaacttgtgccttggccggaggtttggctggatctttaggacaagcactcttctccttggaatcaaaagtcacgacgtcatgagtcgtagatccttccttgtttgcaggctcattattcagatttagcttcagatcaaccgtctctgagaaccctctcttgtttccggttaccggagccactgtatctccaccgggaagaccaagacacagctcagtctccctcagattcagctcgacactgcccatcattattaacctttcttcttctttgggggtcttcttcttgggaaggtgatgagg

SEQ ID NO: 7006 - DNA, 608 bp, Artificial
  Synthetic
tccaacacctcctaatcaccacaaaggggtaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagcta

SEQ ID NO: 7007 - DNA, 452 bp, Artificial; identical to SEQ ID NO: 4648
  Synthetic

SEQ ID NO: 7008 - DNA, 530 bp, Artificial
  Synthetic
ctcgagcttgcggccgcctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgag

SEQ ID NO: 7009 - DNA, 901 bp, Artificial; identical to SEQ ID NO: 4657
  Synthetic

SEQ ID NO: 7010 - DNA, 1032 bp, Artificial
  Synthetic
ccccgctcctcccactctcgcacttctcgcatcgcaaaggggggcagcaaaagcaaagcaaagccaagccaagcttgaagctccccgcactgagccaagaagcctccacctcaatccgaaagagatctcgtgcgcgcacggcgatgcggtgaatcgggcatggcgccgccacaggagcgggactacatcgggctgtcgccggcggcggcggcggaggccgaggaggaggaggagaaaaagaaggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggaactgagcaaaagatgaacccaatatgaatatccgacccctacaatcacatcacttttacttgtaaggtcccattctctaaaccacaagggtaatggtctaagttgcgagaaggggattacttatacctatgtgtcaccctcttttttttttggttttatttgtaccaattatgttagattttaagcgtaagttgtgtaagttcctgtaagttgtctacttaaccttgcttgtagtttcttctgtaaattgttgtgctgtatgatgcaaactatttttgggattttacttg

SEQ ID NO: 7011 - DNA, 922 bp, Artificial; identical to SEQ ID NO: 4646
  Synthetic

SEQ ID NO: 7012 - DNA, 893 bp, Artificial; identical to SEQ ID NO: 4655
  Synthetic

SEQ ID NO: 7013 - DNA, 863 bp, Artificial; identical to SEQ ID NO: 4644
  Synthetic

SEQ ID NO: 7014 - DNA, 1169 bp, Artificial
  Synthetic
aggctcgggctccctgggtctctctctcccgaaaggggcatagagacttgccctttggcctcgaacgagaagctgctttttcccttgcaccctgccaaagatagtgctttggccgtatcacagaaaacagttgttaccggcaacaaacgtggattttcagatgctatggatggattctcagagggaaagtttatgccaaattcaggtgtgaaagcaggcgaaacaaaggagacctcacatgttcaaccaccaaaattgaaagaggcaactaatcagaacacagttccagagaggacttctgctgtgaatgaggcttcaaaccgtgtaggcagcagtgcccctgctaccaaggcacaggttgttggttggccacccattcgatcttttagaaagaatacattagcctctacctcaaagaacaaggaagaggtggatggaaaagctggatcaccagctcttttcattaaggtcagcatggacggtgctccttatttgaggaaagtggacctcagaaactattctgcatatcaggagctctcttctgctctcgagaagatgtttagctgttttacgattggtcaatatggatctcatggagctcctgggaaggagatgttaagtgagagcaaattgaaggatttgcttcatggatctgaatatgtactcacttatgaggataaagatggtgactggatgcttgttggtgatgtcccttgggagatgtttattgatacctgtaaaaggctgagaatcatgaaaggttcagatgccattggcctggccccaagggctatggaaaagtgtcggagcaggaattagcctatctacacatgattaaagctatccatccagcagtactggtatgaaaggaaatggagaaagggtgaagagactcaaaaacttgaatcctttttaaagcattaacaatggctggttgttggtcctggacagcacagcatgggtagatggatggtttgcttagttaacattggcgtttctcatattcgcgtaattaatgtcgtcttaagctctttatcttgtctattaaaaaacccatttgatatttgagtttgtctgcgaactaatgtgtggtgaactgagagttcttctagaggtaatttagtatgttaagtgtattgcttgttgaagtttctttaagtgtgtactta

SEQ ID NO: 7015 - DNA, 302 bp, Artificial
  Synthetic
aacacattggccactacttgtaaaaacagtgacgaagttgatgggaggccaggttctggggctctcttcgtgaaggtcattatggatggcgctccttatctgaggaaagttgacctgaggagctacactaactacggggagcttttttcagccttggagaaaatgttcaccactttcactcttggtcaatgtggatctaatggagctgctgtgaaggatatgcttattgagaccaagctcaaggatcttttgaatggaaaagactatgtgctcacttatgaggataaggatggtgactggat

SEQ ID NO: 7016 - DNA, 317 bp, Artificial
  Synthetic
aataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctattt

SEQ ID NO: 7017 - DNA, 701 bp, Artificial
  Synthetic
gcagcatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttttagttgaaatcgaaaacgcgcagaaaagggagattgagcttgacaatgagaacatctatctaagaactaaggtagcagaagtggagaggtatcaacaacaccatcatcaaatggttagtggttcagagattaatgcaattgaagctttagcctcacgcaattactttgctcatagcattatgactgctggttctggatctggtaatggaggttcttactctgatcccgacaagaaaattcttcatctcggataataa

SEQ ID NO: 7018 - DNA, 665 bp, Artificial
  Synthetic
gcagcatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaatggaaaacactttcaaactcgttcgcgagcgcaagttcaaatctcttgggaatcagatcgagaccaccaagaaaaagaacaaaagtcaacaagacatacaaaagaatctcatacatgagctggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccc

SEQ ID NO: 7019 - DNA, 551 bp, Artificial
  Synthetic
tcacttcttctcaccgaatcccaagccatggatcatgttgtggtctccggaagtaatggaagtaggagagttgggtatgtacttagcccaatttttggcagcagcactgaaagcttcacggtgtggtatttccggattggcacttttgatgcgttggatctcatccctcatgaagcggttgtatgcagatgggagcctctgcttcttctcaggaggtttgacgacaaagggaggtgagggagatgggggctggtcgctggaggtggaggaagaggaagaagaagagcttcccttcttatagtcacttccaccaaagctctgcatctgaagggtgaggctaacatggccttgaagaggaggagttgtggtgagaaacgagaggttaccacaatggccgcatttcaccgttaccgtgtcaagcattctcttcaatggtatcccaaccgcgaggatggtgttgcagatgctacaccggacgtagtagagatgttcggcttgaggggaagcccttgaagccgtcatggttggtttctcttctaggttcatgctgc

SEQ ID NO: 7020 - DNA, 624 bp, Artificial
  Synthetic
catggatcttgctccttttcacgggcacgcactgttcaagatcaccaggtacagaacagaggatttcaaggtaataactttggaagctatgacatagcttccagaaatcagaggacatcgacagccatgtacccaatgccaaccagtcagcagcaagtgtcacctatacgtccccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgcattatacgtactatta

SEQ ID NO: 7021 - DNA, 366 bp, Artificial
  Synthetic
gaagaaagcaaagggcggtgtgcaaaaaaaaatcgaaaatcgaatgctagggattggcagggatccccgcaagaaggggcactggaccgcagaggaggaccgccgtttaatccacatggtacgcttatacggggaagggcagtggaacaaattagcccgcgctgcagggttgccccgatgtgggaagagttgccgtttgcgatgggtgaattacctccggccaggtgtgaaacgaggacaaatcacagaggacgaagaacggcttataatacaaatgcatggtatctatggcagaaggtaaaaatcttaattttaataataatcaatcctcccttagaaaggaaaaaagtccacataacacacaac

SEQ ID NO: 7022 - DNA, 984 bp, Artificial
  Synthetic
attaagagaaaatatttcttagaaaattggctcaaaatgggaaggtcaccatgttgtgagaaagctcatacaaacaaaggagcatggactaaagaagaagatgaaaggcttattgcttatattaaaactcacggtgaaggttgttggaggtctcttcctaaagctgctggccttctcagatgtggtaaaagttgtcgtcttcgttggattaattacttaagacctgatcttaaacgcggtaatttcactgaagaagaagatgaactcattatcaaactccatagccttcttggtaacaagtggtcacttatagctggaagattaccgggaagaacagataacgaaataaaaaattattggaatacacacataagaaggaaactattaagtcgcggtattgatcctactacacacaggcccataaacgagcctaacacaactccaaaagtcacaacaatttcttttaccgttccaaatattaaagatgaagaagatcaaaagatgatcaatgttaaaggtgaattatctggacttagtcaagaagatgaaattagcacaaacagcagccaatttcaagaattacagtgtcctgacttaaatcttgagctcagaattagccctccttatcagcaaaattaccaaaatgaccaagatttgaaacagagtccaaggtgttttgcatgcagtttgggcatacaaaatagtaaagattgcaattgcagtaaaaataatatggttaatattgcaagttatgattttttagggttaaagactaaaggtgttttggactatagaactttggagactaagtgaattaccttttggccccttgtgcatttgggtaaaaaaggaaaagagaattgagaaagagatattagtttaagttctttcgaattttctcttatttgtaaaattgaaagtattattattatattaaactgaaagcagtatagcagtgtaccttacgacatttatactagtagt

SEQ ID NO: 7023 - DNA, 703 bp, Artificial
  Synthetic
aaaaatggccaatagcagtaatagttctaagaaagatatggatcgtgttaaaggtccatggagccccgaagaagacgagcttctacagcagctagttcataaacatggaccacgaaattggtctcttattagcaaatccatacctggaagatccggtaaatcttgccggttaaggtggtgcaatcagttatctccacaagtagagcatagggcttttactcccgaagaagatgagaccattattcgtgcacatgctcggtttgggaataaatgggctactatagcccgacttcttaatggacgaaccgataacgccattaagaaccactggaactctaccttgaagaggaagtcctcctctcttagtgctgatgaaggtaacgaactggtggaccaaatctttcaaaatcagcagccgccgttaaagagatccgttagtgccggatccgccatgccggtgtcgggtttccatttcagtcccggtagcccgtcgggttcggacagtgattccagccttcatgtcacctcatcgtctcaatctcacttattcaagcctgtcgccagagccggcggtgtatttccgccgccgtctatagacacgtcatctccttccgatgatccgccgacttcccttagcctttcgcttcccggagttgacttggccgagttttctaatcgttcggcagagtcaactcagtcgaag

SEQ ID NO: 7024 - DNA, 727 bp, Artificial
  Synthetic
tctgcaaagccaaagcttcgcaaaggattgtggtctccagaggaagatgagaaattggtgaggtacattacgaagtatggacacaaatgctggagcattgtaccgaagcaagctggtctccaaagatgtggcaagagctgccgcttgagatggatcaactatctccgtcccgacttgaaaaggggccacttcacacagcaggaagaagacttgatcatcaagctacatgcgatgctgggaaacagatgggctcagattgctacacagctgcccggtcgtacagacaacgagattaaaaacttctggaactcgtgcctgcggaagaagctgcgccaagttggtatcgacccgcagagtcacaaaccaattccgctcggcattgctcaatcgcgggatgatccaggagaagtgatcgaattgtctgtccacagccaggatcagagctccaatttccggttttgtcaacctcaacatcaacaacaacaatgcggtagcgaccaagtccaaggccaagacaacagcaacggcttcacattgtcgatgctgccagtcacactgagtccgtctggtggacaacagcctcatccttacaggagcatcatcggaatgagcttcgtcccggcgacaacaggattgaattgtcaccaccaagctcagctgcagccgatcgacgacgaccagacagctttctcgccagagacgtcgtcagtgttccccttctggatgg

SEQ ID NO: 7025 - DNA, 377 bp, Artificial
  Synthetic
tggtatcaacgcaaagtggccattacggccggggataacaagctggaaccagagaggaaagttcaattggctcaagaacttggcctacaaccaaggcaaattgctatttggtttcaaaacagacgtgctagatacaagactaaactacttgagaaagactatgatgttctcaaagctagctttgataaactgaaggatgattatgacacccttttcaaagagagtgacaatttgagaaatgaggttgatttgctgaaagaaaaattgcttacgagggagaaagggaaggaaaatgaagcagtagatgcagaagagggtgaaaaggcaactccaaatgttgttacctcagaagtgccaagcatacaaaaggtagtatg

SEQ ID NO: 7026 - DNA, 238 bp, Artificial
  Synthetic
tagcaaggaaagatgaatagggagaagctaatgaaaatggctagtgcggtacgcacaggaggaaaaggaacagtcaggaggaagaagaaagccgtacacaaaactgcaacaacagacgacaaaagattgcaaaataccttgaaaaggctcggagtaaacactattcctggaattgaggaggttaacatttttaatgatgacacagtgatccattttgtcaatccaaaagttcaagctt

SEQ ID NO: 7027 - DNA, 685 bp, Artificial
  Synthetic
gtctctctctctctcttctttcgctggagggattcaggaacaaagacaacgaaaacacagccttctctctctctctctgtctcaaccttagccaggggaagaagcagctaagctaagatgaatagagagaaacttatgaaaatggcgagtgcagtccgcacaggagggaaaggaacagttaggagaaagaagaaagctgtacacaaaacagtagtgacagatgacaaaaggttgcaaagtacattgaaacggctcggagtgaatactattcctggaatcgaagaagtcaacatttttaaggatgacacagtaatccattttgtaaacccaaaagttcaagcttccatagcagcaaacacttgggttgttagtgggtcatctcaaacaaaacaacttcaagacttgctgccgggcataatcaaccaactaggagttgataatttgatgaaccttaggaaaatagcagaagaatatcagaaacaaggaggtgtgggtgttgaggaggatgacgaggttccagagctcgttggagaaaatttcgaagaggctgcaaaagaaacaacccagatacctggagggcaatcctaaaggcgcttgcgatcaatcttttacacacggttgatgctttgtaatgaatggccttataaacttaaaactttcaggttttattacttctaaccctagt

SEQ ID NO: 7028 - DNA, 677 bp, Artificial
  Synthetic
tctctctctctccttttttcacttgtgcttcattttgttgctaagcctgtcggagcttgaaggctacgacactcgtttcaagatgaatcgggagaaattaatgaaaatggccagtgctgtccgcactggaggaaaagggacagtgagaaggaagaagaaggctgttcacaaaacagcaactacagatgacaaaaggctgcaaaatactttgaaaagattgggagtgaacactatccctgccattgaagaagtgaacatattcaaggatgatactgtgattcattttgtgaaccctaaagttcaagcatcaattgctgctaatacctgggttgtcagtggatcatcacaaatcaagaagctgcaagatctccttcctggtatcatcaaccagcttggacctgacaacttgatcaacttgaagaaaattgccgagcaatatcagcagcaggaaaaatcagctgcacaggaggatgatgacgatgttccggagcttgtagaaggagaaaattttgaggaagcttcgaaagaagctaattagccataagatatatatggctggcataacagttttgtctccatttaagtagtggatagccaaatggggagtacttatcgaatccttatatagcccaggtggttgtccttcactgattcttgaaaatgatatcatggacagt

SEQ ID NO: 7029 - DNA, 710 bp, Artificial
  Synthetic
gccattacggccgggatccttctgctcttcatttttggggtgctgactgctgcctagggttttagttctctattcttcaccaagatgaatgtagaaaagctacggaaaatggccggttcggtcaggactggtggtaagggaaccatgcgaagaaagaagaaggccgttcacaagacaactacaactgatgacaagagacttcaaagcaccctaaaaagaataggggtgaatgctattcctgctattgaagaggttaacatttttaaggaggatgtagttatccaattcatgaaccccaaagttcaagcctctattgctgcaaacacttgggttgttagtggttcccctcagaccaagaagttgcaggatattcttcctcaaattattcaccagttgggccctgataatttggagaatttgaagaagctagcggagcagttccagaagcaggcacctagtgccaccggggcgtctgaaggtgctgctgcaccacaggaggatgatgatgatgaggtgccggaactcgtggctggccaaacctttgaagcagccgctgcagaggagggtcacgcttcctaaagtttcaatttaaatttgtatcaacgcctcctccgtctcgacgttttgagatccgtttaatttagttgagtgttctatttgattttgattgtgacaactaaaaaaaaattcatcaaaatggtttttgtagt

SEQ ID NO: 7030 - DNA, 611 bp, Artificial
  Synthetic
gaatgttgacaagctcaagaagatggcaggtgctgtgcgcaccggggggaagggtagcgtgcgcagaaagaagaaggcagtccataagactacaaccacagatgacaaaagacttcagagcactctgaaaagagtaggagtaaacaccatccctggcattgaagaggttaacattttcaaggatgatgtggttattcagtttctgaatcctaaagtgcaagcttcaattggtgctaatacatgggttgtcagtggaactccacaaacaaagagtatgttctccatgccctgtacttcatttctaatgtagcttttatcaataaatcttaaaacaacatttcagcctgtcattttgttctattttcctgtgtagagtagataatagctacccatagtatgtatatgtatgaaagacctaatttggactttccatttctcagagatctttttttgctcaagctaatataatattagctctataaagttgtattattaacttcttgtgtttacataacaataattttatgtttccctttttttgtacagagctgcaggatctgctgccatcaattatcaaccaacttggtatgcctctcgttgcaatttacaat

SEQ ID NO: 7031 - DNA, 682 bp, Artificial
  Synthetic
gtaacattttagcagcgagctggtttggcgacgtctagggttcttggcatctcgtccccggttgccacacactgccgcaaagatgaatcgagagaagctcatgaagatggctagtgctgtgcgcaccggtggaaagggcacagtgaggaggaagaaaaaggctgtacataagacaacgactactgacgataagcgtctccaaaacacgcttaagaggttgggggttaacaccatccccggaatcgaggaggttaacattttcaaggacgacattgttctccactttgtcagtcccaaagtgcaagcgtccatagctgctaacacctgggtcgtgagtggacccgtccagacaaagaagcttacggaattactgcccggcatcatcgaccagctcggctttacggggccggataacttggagaacctcaagaagattgcgcagcaattcaagcggcaagagagcggcggcgggggcggcggcggcgcagctccgctgagcacaatcgaagacgacgaggatgtccccgatctcgttcccggggagactttcgagaagcccgccgctaatccccccgaggaggccgtggccactgcgtgattcccggcagagcatattcctgctgtgtacttgtagcctcctgggcatattctcctttttttgttgcaagtcaatccgtccgtc

SEQ ID NO: 7032 - DNA, 712 bp, Artificial
  Synthetic
gggtttcgctggagggattcaggaacaaagacaacgaaaacacagccttctctctctctctctgtctcaaccttagccaggggaagaagcagctaagctaagatgaatagagagaaacttatgaaaatggcgagtgcagtccgcacaggagggaaaggaacagttaggagaaagaagaaagctgtacacaaaacagtagtgacagatgacaaaaggttgcaaagtacattgaaacggctcggagtgaatactattcctggaatcgaagaagtcaacatttttaaggatgacacagtaatccattttgtaaacccaaaagttcaagcttccatagcagcaaacacttgggttgttagtgggtcatctcaaacaaaacaacttcaagacttgctgccgggcataatcaaccaactaggagttgataatttgatgaaccttaggaaaatagcagaagaatatcagaaacaaggaggtgtgggtgtagaggaggatgacgaggttccagagctcgttggagaaaatttcgaagaggctgcaaaagaaacaacccagatacctggagggcaatcctaaaggcgcttgcgatcaatcttttacacacggttgatgctttgtaatgaatggccttataaacttaaaactttcaggttatattacttctaaccctagtgtggttttaacttgctttttgaaaaaatccgttctaatgaat

SEQ ID NO: 7033 - DNA, 637 bp, Artificial
  Synthetic
cgtgctgtatgtcctctccttctttcttcctttccaaataagcactcctcttcttcctcctcctcctcctccgcctcctcttctcattcccaactcatcgatccatcagtagctagctagctagctagctagctagctgcattgtccggcgagagagataactgctgcagggggcggccatggggaggggcaagatcgagatcaagcggatcgagaacgcgaccaacaggcaggtgacctactcgaagcgccgcacggggatcatgaagaaggccagggagctcaccgtgctctgcgacgcccaggtcgccatcatcatgttctcctccaccggcaagtaccacgagttctgcagcccttccaccgacatcaaggggatctttgaccgctaccagcaagccatcggcaccagcctttggatcgagcagtatgagaatatgcagcgcacgctgagccatctcaaggacatcaaccgcaacctgcgcaccgagatcaggcaaaggatgggagaagatctggacgggctggagttcgacgagctgcgcggtcttgagcaaaatgtcgatgccggcctcaaggaggttcgccacaggaagtatcatgtgatcagcacacagactgaaacctacaagaaaaa

SEQ ID NO: 7034 - DNA, 427 bp, Artificial
  Synthetic
gcagatggaggaaggtgggagtagtcacgacgcagagagtagcaagaaactagggggagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcggcaagaagcctctaagcttcggaggcagattcgagatattcagaattcaaataggcatattgttggggaatcacttggttccttgaacttcaaggaactcaaaaac

SEQ ID NO: 7035 - DNA, 672 bp, Artificial
  Synthetic
gcagcatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgg

SEQ ID NO: 7036 - DNA, 705 bp, Artificial
  Synthetic
cggacgcgtgggcggacggtgggatgaaagccaagaaaaaaaaattaaatggaaagattataaaaatccctagagaggatgatagtggatatggaacgatacaaatattatactccctagataaaaaaggaatctaaaagatttccaaattgggcaaattaatggggcgtaagaaagtagaaatcaaacggatcgaagacaagaacagcaggcaagtgacgttctctaaacggaggaaaggactcctaaagaaagccaaagaactctccattctttgcgatgctgatgttgccgttattgtattctccaaccgtggcagactctatgacttctccagcactaacagtatcacagagaatgttcaacggtaccacagccatgtggaagcagaaaaagatatctctgcaggagttttggacactgagcactctaaatattcaagcttcataacagtgggagaactgttacaaacggtagaaaggcaactcgaggaacctgctgttgatgatctcagtgtgactgaccttgtccatttggaaaacaacctgcaaactgctctaatgcaagccagatctagcaagatgcatatgatgattgaatctatcaaaagtcatcgtgagaaggaaaaactgctgagtgaagaaaacaacatctggagaaccagatagctacgatgaagaacaagagagaagtgaagaatgggat

SEQ ID NO: 7037 - DNA, 665 bp, Artificial
  Synthetic
tcttaataattggaatttgtgagagttttccgaaaggttttgaagtcgccggaaaatagcaatattttccattgaagccaatcagatgggtcgaggaaagatagagataaagaggatagagaacaacacaaacaggcaggtgacattttgcaagagaagaaatggactcctcaaaaaggcctatgaactttcagtactatgtgaagctgagattgctcttattgttttctccagccgtggccgcgtctatgagtactctaataacaacattaaggcaactattgatcggtacaagaaggctacttcagaaacctctaacgcttgcaccactcaagagctcaatgctcagttttaccaacaggaatcgaaaaagctgcgccaacagatacagatgatccagaattcaaacaggcatttggttggtgaaggcttaagctctttgaacgtaagggagctgaagcagttggagaatagacttgaacgaggcattactagaattaggtcaaaaaagcgtgagatgatactagcagaaactgagaacttgcagaagagggaaattcaacttgaacaagaaaatgcattcctcagatcaaagatagctgaaaatgagaggcttcaggaactaagcatgatgcctactggtgggcaagattacagtgcaattc

SEQ ID NO: 7038 - DNA, 499 bp, Artificial
  Synthetic
tggtatcaacgcagagtggccattaggccgggcaattaccacagtcaaaaaattagtagatccagagcgaagtgaattatagagaagatgaatcggcgtgagtaccataattagtaacatagtctaattaaaaattttaaggcgaaaaaggaggagagtccaaacactcggaggtactttatgaaattcgtgaaagtgatggagatggaggtacaaatcttatatatttagacatggaacgataatattgagaaaattggggttggggagattgaagaaattaagtatgggaaggaagaaagtggaaataaagcgaatcgaagacaggagtagtaggcaagcgactttctcgaaacggagaaacggactgatgaagaaagccaaacagctctctattctctgtgacgtcgatgtcgccgtcatcgtcttctctagccgtggacgcctctttgaattctccagtactaacagtttgacaggaataattcaacgatatcac

SEQ ID NO: 7039 - DNA, 539 bp, Artificial
  Synthetic
caacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattgagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaactggaggagagcaaccagttgcatggacaagtgtgggagcacggcgccaccctactcggctacg

SEQ ID NO: 7040 - DNA, 487 bp, Artificial
  Synthetic
aaaagtttctagggcttgccttcttccggggtttgcgccggattcgcgataaaaaaccctagcgctagatctttaagctgctgctgctgcggcgcggcgccacgcggattcgggcattctctcgctgtgatttccccctcttcgcggcggcgctggtaatctttgtgtcgatcatccatggccgaagggactgagccggtggatcttgccaagcatccgtctggaatcataccgacgttacagaacattgtatcgactgtgaacatggattgcaaattggatcttaaaaccattgcgctacacgcgaggaatgccgagtacaacccaaagcgttttgctgccgtgatcatgagaataagggagcccaagacaacagcgctaatctttgcgtcgggaaagatggtttgcactggtgccaagagcgaacaaaaatcaaagcttgcagcaaggaagtatgctcggatcatacaaaagctgggatttcctg

SEQ ID NO: 7041 - DNA, 833 bp, Artificial
  Synthetic
gcagcatgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatgataa

SEQ ID NO: 7042 - DNA, 341 bp, Artificial
  Synthetic
cccacgcgtccgtgatcatcacatgaataagtagaagatatctcttaccttctccttcttctaataagatcagagttttggttcttatttctttgctctcaaaacaatgggtagatcaccgtgttgtgacaaattgggtttgaagaaaggaccttggacaccagaggaggatcagaaacttttagcttatattgaagaacatggtcatggaagttggcgttcattgcctgagaaagctggtctccatcgatgcggaaagagttgtagactaagatggactaactacctaagacctgacatcaaaagaggcaaattcaacttacaagaagaacaaaccatta

SEQ ID NO: 7043 - DNA, 406 bp, Artificial
  Synthetic
tggtatcaacgcagagtggccattacggccggggaagagagaggggagagagagaacagagtggaatggaattattcaaatatctcttcttctcttgccttggcctcttttcaagaataataatctaagatgacgttcgcaggaacaacccaaaagtgcagtgcttgtgagaaaacggtgtatctggtggatcgtcttgctgctgataatcgcatttatcacaaggcttgcttcaggtgctaccattgcaaaagtactctcaaggcctcactttgatcagctttttaagagaactggaagtttggacaagagttttgaaggaactccgaaactcacaaagccagaaaaaccagtggagaacgagaatggtagcgggagcaaagtctcaaatttatttgcaggaacg

SEQ ID NO: 7044 - DNA, 698 bp, Artificial
  Synthetic
ggtctggatctacttacttgtgttccttcaaagagtggaaaaataataataataataataataaaagcaagaatggcgttctccggcacaacccagaagtgcaaagcgtgcgataagacggtgtacctggttgaccagctcactgcagacggcgcttccttccacaaagcatgcttccgctgccaccactgcaatggcaccctcaacctcaacagttactcatcgtatgaaggaacactctattgcaagccccacttcaatcaactctttaagatgacaggaagtttggaaaagagctttgactcaggaaaaacaacgaagattcgagagaggggaatcgataatgaagggtatagaccgccgagcaagatctcatctctcttctcaggcactcaagaaaaatgcttggcgtgcggaaagactgtgtatccaattgagaaggtaagcgtggaggggcaatcatatcacaggccatgtttcaagtgtagccatggggggtgcactattagcccttccaattatgtcgcccacgaggggcgattgtactgccgccaccatcactcgcagcttttcaaggagaagggcaatttcagccaactggttaagctaccccctgcaaaagtagatgatgctcaagatgcaactatattaaaggagtgagtatagatcatatctatcctcattaaatgatcccctac

SEQ ID NO: 7045 - DNA, 398 bp, Artificial
  Synthetic
cccacgcgtccgtggcctgtgacaaaacagtttatcttgtcgacaagttaaccgccgataaccgggtctaccacaaagcttgtttccgatgtcaccattgcaaaggaactctcaagcttagcaattacaactcctttgaaggagttctctactgcagaccacatttcgatcaaaacttcaagagaactggaagtcttgagaaaagcttcgaagggacaccaaagattgggaaacctgataggcctttggagggagagagacctgctggaaccaaagtttcgaatatgtttggtggaacacgagagaaatgcgttggttgcgacaaaaccgtgtatccaattgagaaggtatcggtgaatggaacattgtaccacaagagctgcttcaagtgtacacat

SEQ ID NO: 7046 - DNA, 587 bp, Artificial; identical to SEQ ID NO: 144
  Synthetic

SEQ ID NO: 7047 - DNA, 113 bp, Artificial
  Synthetic
caagtcttgcttcaaatgcactcactgcaaaagcaggcttcagctgagtagttactcatcaatggaaggtgttttgtactgtaagcctcattttgagcagctctttaaggaga

SEQ ID NO: 7048 - DNA, 715 bp, Artificial
  Synthetic
ggggtggtgtgtggctgatgcaggtttgcagcgcagcgggaagagctgccgtctccggtgggtgaactacctgcatccagagctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaatcatgtgggagtactcagctcatctcaattgttacatccttgctacagctgctaattac

SEQ ID NO: 7049 - DNA, 287 bp, Artificial
  Synthetic
gttactacaataaagcaccagtattaatgtagttgacagtactgctccaaatctctctccctgaatcaatctgatcaacatgaccatgaccatgaccacttcctcctcccatgttcatctgccaggggaatccccacaaaaccctgtttggatcacttgtcgccatctgctccataccgcctccaccatttccaaacgcataccccgtgttctccatctgatggctcgtggtcccatacacgccatccatggccattggatactgacagcttccgaaccctatatgt

SEQ ID NO: 7050 - DNA, 525 bp, Artificial
  Synthetic
gcagcatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgagatagaagcgctgttcaagccggagaaacctcaatgttttgaactcgatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgacagaggaa

SEQ ID NO: 7051 - DNA, 608 bp, Artificial
  Synthetic
ccccccctgtacctaagagaaacttttcaaataaaggagggtgacttcctgaccttcgatgctttgaggcaagctgcgcaatgtgttggccgtgtgatccgttctaaagcagattatggaatgatgatatttgctgacaagagatacagtcgccatgataaacggtctaaactgcctgggtggatactgtcacacttacatgatgcgcacctaaatctgagcactgatatggctttgcatatagctcgtgagttcctacggaggatggcgcagccttacgataagacggggagcggcggcaacaagactctcttaaccgaaaaggatttgcaaaatatggcgcaggacgccatggagatgtgaaaccatgaaagaaattgaaagagagggagggggagagagagttttctgctgtacaatacattcaaaattgaggtagaagtcactaatgtacaaaaaaattttggctactcatgtgaaccagcatgaattcgagctgcacggttcatgctaaattgctaacaaattggtccttccaagcacatgtgatattactctgcatctgatataggtatgtacaccttaaagtccttccggataaaaaaaaa

SEQ ID NO: 7052 - DNA, 674 bp, Artificial
  Synthetic
gcagcatgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaagagcagaggcttgtgatccgtcttcaggagaaacacggcaacaagtggaagaagattgctgctgaggttcccgggaggacggcaaagcggttagggaagtggtgggaagtgtttaaggagaagcaacagagagaagagaaagagagtaacaagagagttgagcctattgacgagagtaagtacgatcggattctcgagagtttcgctgagaagcttgtcaaagagcggtctaacgttgtccctgctgctgccgctgctgcaacggttgtgatggctaattcgaatggagggtttttacattctgaacaacaagttcagcctcctaacccagtgatcccgccttggttagctacttctaacaatgggaacaatgttgttgcaaggcctccctcggtaactttgacattatcgccttccacagtggctgcagctgcgcctcaaccgccaatcccgtggctgcagcagcaacagcct

SEQ ID NO: 7053 - DNA, 412 bp, Artificial
  Synthetic
ctcacaaaaaggtaaagctagagaggccataatacttcaaaagagagagaagcaagcataaaatgagcataaaatggcgcaagaggaagcaagataaggtccatggagtgaacaagaagatctccaactagcattttatgtgaatttatttggagatcgacgatgggatttcttgtccgaagtttcaggtttttaaaggttggagggagactcatataataggtaatatttaggacatgaaatccttttttcttggagcaatttctaaccctaatatctggattacggttgaaaagaacaagatagagttgcatggtacatcggttaaattacttgcatcctggtcttaaacgtggtaggatgacaccttgagattaacgacttattcttgaactccactctatatggggaa

SEQ ID NO: 7054 - DNA, 557 bp, Artificial
  Synthetic
ttatgtccaaagagttaagtatctctaaccctattcttctctccatattctttttctttgtaatgttcttttggtttaggtttgaaaagaacaggaaagagttgcaggttacgttgggttaattacttgaatcctcatcttaaacgtggcaagatgactcctcaagaagaacgtcttgttcttgaacttcactctaaatggggaaataggtctgctatttctttagattcttttttttttttttaatttctcatattaagtatcatgcttaactattcacatttattttaacatttacataaaggtctaaatttacctctatattatatacgaaatatcaaaaagggagcattagcattaccgataaagttattgtcatgtgactaagaggaggtcatggattcaagccgtgaaaacagtcacttgcagaaatacagggtgaagctgcgtacagtagacctttgtagaccggcccttcctctaaccctgcatgtaacagaagcttagtatatcggactggcctcctcgttatatacgaaatatcataattttactct

SEQ ID NO: 7055 - DNA, 664 bp, Artificial
  Synthetic
gcagcatgggaaaatcttcaagctcggaggaaagtgaagtgaagaaagggccatggactccggaggaagacgagaagctcgtaggctatattcaaacgcacggtcccggcaaatggcgtacccttcccaagaacgccgggttaaaaagatgcgggaagagttgtagattgcgatggacgaattatctaagacccgatatcaagagaggagagttctctcttcaagaggaagaaaccatcattcaacttcatcgtcttcttggaaacaaatggtccgcaattgctattcacttaccaggaagaacagataatgaaatcaaaaactattggaacacacatattaaaaagaaactcttacgaatggggattgatccggtgactcattgtccccgcattaatcttctccagctctcttcgtttcttacctcatcattgtttaaatctatgtcacaaccgatgaatactccatttgatctcactacttcaaatattaatcctgatatcttgaatcatctcactgcctctctcaacaacgttcagaccgaatcataccaaccaaaccaacagcttcaaaacgacctaaacactgaccaaaccactttcaccggtttgctcaactcaacaccacccgttcaatggcaaaacaatggagaatacttgggaga

SEQ ID NO: 7056 - DNA, 403 bp, Artificial
  Synthetic
cccacgcatccacgcgttcggagaagtaaaattttctattgcagagagaaagagagttagagaaagagagagagagatgaaacttgtgcaagaagaataccgtaaaggaccgtggacagaacaggaggacatcctcttggtcaactttgtccacttgttcggagatcgaagatgggattttgtagcgaaagtttcaggtttgaaggtggagggagaaacataagaataggtttaaacagaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccggaaattaccggcgagaacagataatg

SEQ ID NO: 7057 - DNA, 481 bp, Artificial; identical to SEQ ID NO: 4616
  Synthetic

SEQ ID NO: 7058 - DNA, 662 bp, Artificial; identical to SEQ ID NO: 4606
  Synthetic

SEQ ID NO: 7059 - DNA, 714 bp, Artificial
  Synthetic
tttttagctttctaaatgtatgtatagacacaagtgagatttctgagctttgtcatccccagtgaagaagactgagctgcatattacctcacaaccaactatccaaatgcaatcatggtggcagggttatggtgataatactatgcctttggcaagtgaaaatactgttgcccaggggaatgctgacggtggcaatgaagaaaaagaaacaaatgcccaagccacagaatctggatcaaaaggaaataacatgcaatacaagaaccacctcaagcatattacatccacaactgccgccatcatgggtgagcagcagaagggactcacaggtcattcagctatgttgacatcatatccatatccagatctgcagtatggaggaatgatgacttatggagctcctgtacaccctcacttatttgaaattcatcatgcccgaatgccgttgcctcttgacatggaagaggaaccggtctacgtgaatgcaaaacagtaccatggaattttaaggcgaagacagataagagctaaagcagagctggaaaagaaagctattaaagcgagaaagccatatttgcatgaatctcggcatcaacacgctatgagacgggcaaggggaactggaggccgttttctgaatactaaaaagctcaatgacatggactgtacgacagaggagcctaaaaaatatggggctactattccaactcactc

SEQ ID NO: 7060 - DNA, 980 bp, Artificial
  Synthetic
gcagcatgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggagaatagtcgattaaagctgactcaacttgagcaggagctgcaaagagcaagacagcagggagttttcatctcaagttcaggagaccaagctcattctactggtggcaatggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcagctaagaatgatgtcttccactcgttatctggaatgtggaaaacaccagctgagcgatgtttcttgtggcttggcgggttccgctcatccgaacttctcaagctccttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatggggcagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccagccaagagagtga

SEQ ID NO: 7061 - DNA, 621 bp, Artificial
  Synthetic
ggcacatattgtcgggcatgtggaaaactccagcagagagatgcttcttgtggctgggtggattccgttcgtctgaactgctcaagctcctcattaaccagctggagcctttaaccgaacaacaattattggcaatcaacaacttgcaacagtcatcccaacaggctgaagatgctttatcccaaggaatggaggcactgcagcagtctttggctgagactttggcagggtcccttggaccttcaagttcctcggggaatgttgccaattatatgggtcaaatggccatggcaatggggaagctcggaactcttgagggcttcatacgacaggctgataaccttcggcaacagacattgcagcaaatgcatcgtatattgacaactcgccaatcagctcgtgctcttcttgcgatcagtgattatttctctcggcttcgagcactgagctctctctggcttgctcgtccccgggagtaacaactgctttcttctaatactctgctatgaaatattcttggtaacatttgtaaatgagaaaccttcttctgggagcactaccgagctttaacggatataattattagattttcagccaccagttcagtccttgttcatttca

SEQ ID NO: 7062 - DNA, 645 bp, Artificial
  Synthetic
cccacgcgtccgcggaacgcccgtgggaaaagcttcttgtgaatcagctcgagccattaactgagcagcagttgttgggactatcgaacctccaacagtcctctcagcaggctgaagatgctctatcacagggaatggaagcgttgcaacaatccttggcagatacgttggccgggtcccttggtccatcaggatcttcagggaacgtggcaaactacatgggtcaaatggctatggccatgggcaaacttgggacccttgagaatttcctccgtcaggctgacaatttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgta

SEQ ID NO: 7063 - DNA, 707 bp, Artificial
  Synthetic
gcagcatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcactccaagctcatataggtgacattgagctcaaaatgttggtagatagttgcttgaaccactacgcaaatctcttccgcatgaaagctgatgctgcaaaggctgatgtgtccttcttgatgtcgggaatg

SEQ ID NO: 7064 - DNA, 650 bp, Artificial
  Synthetic
ttttgcagattatttctcagtttctctccatataaagcaacatcttttttaccttcttcgactctatatatttatttcaggctcataacctaagtattgaaaacgcctaaaaccccttctttcccgcccagagtaaacctgcatgtgatcttaatttcaaagatgcaaatctctgtagcgactataatcccaaaagtgccttcattcaccacattttaccagttcacctcaattccagctcaacacggtcttaaaatgtcgaaccatggtctctcagtacaaacacacatcgatcttccagctccatgtgctgtcaaaagttcctctactggcttcttatctgccattgagagagcaatagaggaagaagagtatagaaaagcccgggctgaggtgaaccggcaagggattaatattgaaggttattcaattgaaggacactcgattggtgggcatgagacctgtgttattgtgccgcaactgaaagctgcttttgatattgggagatgcccatcaaaggctgttcatcaaaacttcttgtttatcactcacgctcatcttgaccacattggtggacttcctatgtatattgccactcgtggcttgtacggcttgaaacctccgacagtcttcgtacctccttccataaa

SEQ ID NO: 7065 - DNA, 669 bp, Artificial
  Synthetic
aaacactcaagtaacgacaccgcacaccgtcgtcaaaatggtcaacattcccaagacccgtaacacctactgcaagggcaaggagtgccgcaagcacacccagcacaaggtcactcagtacaaggccggcaaggcttccctgttcgcccagggtaagagacgttatgaccggaagcagagcggttatggtggtcagaccaagcccgtcttccacaagaaggccaagaccaccaagaaggtcgtcctgcggttggagtgcgtcaagtgcaagaccaagttgcagctggccctgaagcgatgcaagcacttcgagctgggtggtgacaagaagacaaagggtgctgctctggtgttctaaatgcgttgttctccggtattatcaattcttatgcttctcctggcggcatacgggcatcatggaacttggcgaagggggtactggtccttgtttagaggacagcggctcataggaaacgaataaaaagatttcttcatggaccgcattcacgcgttttttactgggatatgctttacagtgttatggtggaaaagccaacctgggacaatattccaattcacgatggcctggtgtctctgtgctaggcaactttagttcatggaggaggctcagactagctaacatgaaaagaagccgaatttcaccctttt

SEQ ID NO: 7066 - DNA, 420 bp, Artificial
  Synthetic
gcatttcggcggcatcgtcttccggcacaatggtgaacgttcccaagacgaagaaatccttctgccaagggaagaactgccgcaagcacacactgcacaaggtcacgcagtacaagaagggcaaggacagcctctacgtccaaggtaagaggcgttacgaccgcaagcaatctggctatggaggtcaaaccaagcccgtgtttcacaagaaggctaagacgaccaagaagatcgtgctccggctccagtgccagacttgcaagcgcgtctctcagcacccactaaagcggtgcaagcactttgaaatcggtggtgacaagaagggcaagggaacgagcttgttctaagcaccgggtctttttttcctacttcgatgttctcaaattttcaagcaatatcataacttcgatactatactaa

SEQ ID NO: 7067 - DNA, 580 bp, Artificial
  Synthetic
gaaacctatggtaagggcgtaggcattgacagacgtctggttagaggtagctgttcgacttgcagtcatggtgaacgttccaaaaacaaagaaaagcttttgccagggcaaggactgcaagaagcataccttgcacaaagttactcagtacaagaagggcaaggacagtctctacgtgcaaggtaagaggcgttatgaccggaagcaatctggatatggaggtcaaaccaagccagtctttcacaagaaggctaaaactaccaaaaagattgtactgaagcttcaatgccagggttgcaaacgtgtaactcagcatcctatcaagaggtgcaagcattttgaaattggtggtgacaagaagggaaagggaacatctctgttctgagctgttgcattgcttttgtcttcttttttagtcttgatctttatctcgatgtagtccaattaaagcttaatttaaataccccaacggatcctatctggttctgtagttgcttcagatatcagattaatgacaatgtagtttatttgagaattaatatcaactcttaccattattatgaatcggattccccactgg

SEQ ID NO: 7068 - DNA, 653 bp, Artificial
  Synthetic
catttctgtctcactcttcgccggcgacaatggtgaacgttcctaagacaaagaagacctactgtaagtcaaaggagtgtaagaaacacactttgcataaggtcacacaatacaagaagggcaaagatagcttagctgctcaaggaaagcgtcgttatgatcgcaagcagtctggatacgggggtcaaacaaagcccgtcttccacaaaaaggcaaaaacgacaaaaaagattgtgttgagattgcaatgccaggggtgcaaacatgtttcgcagcacccaatcaagaggtgcaagcattttgagattggcggggacaagaaaggaaagggaacctctcttttctagattgcctgtgaagcggaatgtaacagatctttcacccccttctgttctgttacactgttcagatactttggtaatatttgatgtagtgcaggagtttctgttattgaatcatgtgatcaattttgtgatgtcttagagaatctgataaggagagaaaatgaatattttaagtttttggtttagtatcttgttgcctaaatctattgcaagaaagttatgctgctctacctcacttggctgcatcaatttgtatgttgggattatattataggttgttttctccaaactagtgtatattgaaacact

SEQ ID NO: 7069 - DNA, 467 bp, Artificial
  Synthetic
acctcaccgcccttcgacgaccgaaataccgtcaaaatggtcaacatcccgaagacgcgcaggacctactgcaagggcaaggaatgcaagaagcacacccagcacaaggtcacccagtacaaggctggcaaggcctccctcttcgcccagggtaagcgtcgttacgaccgtaagcagtccggttacggtggtcagaccaagcccgtcttccacaagaaggccaagaccaccaagaaggtcgtcctcagattagaatgcacttcgtgcaagaccaaggcgcagctcgctctcaagcgctgcaagcacttcgagcttggtggtgacaagaagaccaagggtgccgctcttgtcttctagatgggtgcataacggttatggcgctagggatgatgatggagcggtctgtgcatgtagcctcctcgagtacatgatccttgagggctcggaatcaaagcttcgtttctccg

SEQ ID NO: 7070 - DNA, 400 bp, Artificial
  Synthetic
taatcctcgactcgcgacaatggtgaacgtacctaagacaaagaagacctactgcaaatccaaggagtgcaaaaagcacaccttgcataaggtcacacaatacaagaaaggaaaagatagtcttgctgcccaggggaagcgtcgttatgatcgtaagcagtcaggttatggtggacagacaaagcccgtcttccacaaaaaggcaaaaactacaaagaagattgtcttaaggttgcaatgccaggggtgcaagcatgtctctcagcacccaatcaagaggtgcaagcattttgagattggtggggacaagaaaggaaagggaacctctcttttctagattgcctgtgatgcaaaatttgatagttttctgttatacgtttttagatatctttttttgttg

SEQ ID NO: 7071 - DNA, 625 bp, Artificial
  Synthetic
tttgtcatactttctgattgggaggggagggtgagctctcttctgaagcagccatggtgaatgttccgaagaccaagaagagcttttgccaaggcaaggattgtaggaagcatacgcttcacaaggtcactcagtacaaaaaggggaaggatagcttgtatgtgcaaggaaagaggcgttacgaccgaaaacagtcgggatatggaggtcaaactaagcctgtcttccataagaaggcaaagaccactaagaagattgtccttaagctgcaatgtcagtcttgcaagcgcgtgattcaacatcccatcaagagatgcaagcactttgaaattggaggtgacaagaagggaaagggaacttccctgttctaaatctcatcatttttctatcagttttggcttgggatccctgatcttattgtgttggagctcttccgtattccatataagaactaattcttagtctttctgagctcttactatatgaacttattatagtccaatgcacaattatggctactcttactatatgaacttattatcatccgatgcacaattatgactactcttactatatgaacttataatccgatgcacaattatggccaatttttaaaagccgaaaa

SEQ ID NO: 7072 - DNA, 1013 bp, Artificial
  Synthetic
gaaaccccactactgctgttgctgaggagaagataagtgcactggagggtgctgaatcaaccttgttaatggcatctggaatgtgtgctagtactgtaatgttgttggcattagttcctgctggtggacatattgtaacaacaactgattgctacagaaagacccggatatttattgagacgatactgcctaaaatgggaatcacggctacagtcattgatccagctgatattggagctctagagtcagtcctaaaacagaagaaagttactcttttctttaccgagtctccaacaaatccattcctgagatgtgttgacattgagctggtatcaaagatttgccatgaaaatggagcattggtttgcatagatgggacgtttgcaactcctcttaaccaaaaggcccttgctctaggggctgacctcgttgtgcactctgcaacaaaatatattggtggccacaatgatgttcttgctggttgcattagtggacctgaaaagttagtttcagtagttcgtaacttgcatcatatcctgggtggtgctatcaatccgaatgctgcgtatttgatcatcagaggtatgaagacgctgcatcttcgtgtacagcaacagaactcaactgcacaaaggatagccgaaattttagaggctcatcccaaggtgagatgtgtctattatccaggcttgccgagtcatccagaacatcagctggcaaagatacaaatggctggttttggtggtgtggtcagctttgaggttgatggggatctgctgactactgcaaaattcattgatgctctgaaaattccttatattgctccatcatttggaggctgcgagagcattgtggatcaaccagcaataatgtcttactgggatcttagccagtcagacagagcaaagtatgggatcttggacaacttggttcgattcagctttggagtggaagactttgaggatttgaaagctgatattcttcaggctctggaggccatataagaccgtctt

SEQ ID NO: 7073 - DNA, 606 bp, Artificial
  Synthetic
attggaggctgcatcagtggcagagatgagctagtttccaaagtccgcatctatcaccatgtagttggtggtgttctaaatccgaatgctgcctacttgattcttcgaggcatgaagacactgcatctccgtgtacaatgtcagaataatactgcaatgcggatggcccaatttttagaggaacatccaaagattgcacgtgtctactatcctggtctgccaagtcacccagaacatcacattgccaagagtcagatgaccggctttggtggtgtcgttagttttgaggtttctggagactttgatgctactaggagatttattgattctgttaagataccctatcatgccccatcatttgggggctgtgagagcattattgatcagcctgccatcatgtcttactgggattcaaaggagcagagagaaatctatggaatcaaggacaacttgatcaggttcagcattggagtggaggattttgaggatttgaagaatgacgttgttcaggcgcttgacaagatctaagcacctgattgcatcctcatcatgagagttcatctatctgatcttgtttgcctctgcatcacgtggagaactttgata

SEQ ID NO: 7074 - DNA, 570 bp, Artificial
  Synthetic
gaattcaggggccatcttgagagtagttaggaacttatttttgacactattactagtactaattgttagtgttgatgccaaaatccctggagtttatacaggtggtgattggcaaagtgctcatgcaactttctatggtggaagtgatgcctctggaaccatgggtggagcatgtggatatggaaacttatacagccaagggtatggtgtaaacacagcagcgttaagtactgctttgtttaacagtggtttaagttgtggtgcttgttttgaactcaagtgcgctgatgatcctaaatggtgtcattccggtagtccttccatcttaattacagcaaccaatttctgtccacctaattttgctcaagctagtgacgatggtggttggtgtaatcctcctcggcctcattttgatcttgccatgcctatgtttctcaaaatcgccgaataccgtgccgggatcgttccggttgcttaccgccgggtaccatgccgaaagagcggaggaataaggttcacaatagacggattccgttacttcaatttggttttgatatcaaacgtcgccgg

SEQ ID NO: 7075 - DNA, 822 bp, Artificial
  Synthetic
aaatgggttcaatgggagtcatcacttccattcttagtcgaattttccttgtttctcttgttgaagcaagaatccctggtgtttattctggtggttcttggcagactgctcatgctacattttatggtggcagtgatgcttccggaacaatgggtggtgcatgtggttacggcaatttgtacagccaagggtacggagtgaacaatgcagcgttgagcacagctttgtttaacaatgggttaagttgtggagcttgctttgagattaaatgcacaaatgatcccaattggaagtggtgtctccccggaagcccatccattttaatcactgccaccaatttctgtccaccaaactacgcaaagcccaacgacaatggtggatggtgcaatcctccacgttctcactttgatcttgccatgcctatgttcctcaagattgccgagtaccgtgctggcattgttcccgttacttatcgccggataccatgccgaaagcgaggaggaatgagattcacaatcaatggcttccgttacttcaacttggtattgatcacaaacgtggcgggggcaggagacataataaaggtgtgggtgaaagggtcaaagactaactggatacccctgagtcgcaattggggtcaaaattggcaatcaaacgctctcttgacagctcaatccctctctttcagagtcaaagccagtgaccatcgctcttctacttcatggaatattgtcccttctcattggcaatttggccagactttcactggaaagaatttcaaagtctaatatcattcaaaacaaacataattgaagatttgac

SEQ ID NO: 7076 - DNA, 505 bp, Artificial
  Synthetic
aaagaatatattcctccttctcaaaaggagctaaaatccatggcctcttttcaccatagatggagcttgatattcttcttcgttgacgcggcactagcactcatcaatcaagcaaacgccgggggatattccacccctagcgtcgcctttacagcgaccccttggaaactcgctcatgccacgttttatggcgatgagactgcacaagagacaatgggtggagcttgtggatatgggaatttattcaattcaggttatggaacagatacagcagcattgagttcagtgttatatagcaatggatattcatgtggacaatgctaccaaataaaatgtacacaatcagaagattgctactcaaccattgtcacagtcactgcaaccaatctctgcccaccaaattggtcacaagactcagatcagggtggttggtgcaatccacctcgtatacattttgacatggctaaacctgctttcatgaaaattgcccaatggaaagctggca

SEQ ID NO: 7077 - DNA, 634 bp, Artificial
  Synthetic
attttcttaacaatcttgttatttcttctgctattggcaaccactaagaaaaatggctaacaatggcattctagcactgggattcataattggtttgtgcaaccttttcttaagtgcaaatggtttttcagcagattctggatggtcaagtgctcatgccacattttatggtggagctgatgcttctggcacgatggggggtgcttgtggatatggaaacttgtattcaacagggtatggaacaaggacagctgcattgagcactgcattgttcaatgatggaggatcctgtggccaatgctacaagatcatatgtgattataaggcagaccccgcatggtgcaagaagggagtatctgttacaattacagctacaaatttttgcccaccaaattacaatcttcctagtaacaatggaggctggtgtaaccctcctcgtccccattttgacatggctcaacctgcttgggaaaagattggtatttacaaaggaggcattgttcctgtgctctacaaaagggttccttgcaagaagaaacatggagttagattcacaatcaatggaagggactattttgaactagtcttggtaagcaatgtagcaggggcaggatctgttcaatctgttcaaatc

SEQ ID NO: 7078 - DNA, 597 bp, Artificial
  Synthetic
gaattcgtgatgcatctggaacaatgggtggtgggtgtggttatgggaatctctacagccaaggttatggaacaaacacagcagctttgagcacagcaatgttcaacaatggtttggcatgtggatcttgttatgaaatcaagtgtgtgaatgaccggaaatggtgtttgcctggttccattgtggtcactgctactaatttctgcccaccaaataatgctctccctaacaatgctggaggctggtgtaaccctcctcaacaccattttgatcttgctcagcccgtttaccaacacattgctcagtaccgggccggaattgttcctgttgcttacagaagggtatcatgcaggaagagaggaggaattaggttcacaatcaatggacattcatacttcaatttggttttgataacaaatgttggtggagctggtgatgttcatgctgcatacatcaaaggttcaaggactggatggcaagctatgtcaagaaactggggtcaaaactggcaaagcaattcttatctcaatggacagagtctttcattcaaggtcattacaagtgatggcagaactctgacttcgtacaatgttgcac

SEQ ID NO: 7079 - DNA, 749 bp, Artificial
  Synthetic
atggcatctttcaactgcagatggatattgagtttcttccgcattgcgacaatggcgctttttcaccaagcaatagcctacggctactattccacccctaagtttaacgccctgccatggaagcttgcttatgccacgttctacggagacgagactgcttctgagacaatgggtggagcttgtggatatgggaatttgttcaattctggctatggaacagctacagcagcattgagcacggtgttatttagcaatggatattcatgtgggcaatgcttccaaataaaatgtgtgaactctaagttttgctacaaaggatttaccaccgttacagccacaaatctctgcccacccaattgggcccaagactccaaccatggtggctggtgcaacccgccacgtcaacactttgacatggctaaacctgctttcatgaaaattgctcaatggaaagctggcattgtccctgttatgtaccgcagggtaccttgcatcaagaaaggcgggatccagttcgcgttccaaggaaacggctactggttattagtatacgtgatgaatgtcgctggagggggagatgtggcaactatatgggtgaagggaagcaaaacagggtggatgaaaatgagccataattggggagcatcataccaggcatttgcaacactttcaggacaatctctttcgttcaaacttacttcctacacaaatcatgagactattgtagcttataacgttgcaccttctaa

SEQ ID NO: 7080 - DNA, 757 bp, Artificial
  Synthetic
tactcgacccacgcgtcgtgctgtcaccatagtctttcgctacttcctcattccctctctccagcttctttccttttcttttctttgcaagcgtagttcatcatggctgctacactttgccttttccctcttcgtctctgcctggcattgttcttaatgccttccttgcttggactcctaagcatagtagccactgcttttgcccaaagtggatggaactctgctcatgccaccttctatggtggaagtgatgcctccggaaccatgggaggtgcttgtggctatggtaatctgtatagccagggctatgggaccaacactgctgccttgagcactgccctcttcaatgcagggatgtcatgcggggcgtgctttgagatgaggggtgctgatgaccctcagtggtgcctccctggttctatcattgttactgccaccaatttctgcccccctaataacgctttgcctaataatgctggaggctggtgcaatcctcccctccaacatttcgacatggcccaacctgccttcctgcaaattgccaagtacaaggcaggcattgtgccagtgcaatacagaagagttccctgtgagaagaagggcggcgtacacttcactgtgaatgggcattcctacttcaacctagtcctgctaagcaacgtaggaggtgcaggggatgtccacgctgtgtctataaaagggtcaaagacaggctggcaagcaatgtctcgcaactggggccagaattggcaagcaa

SEQ ID NO: 7081 - DNA, 670 bp, Artificial
  Synthetic
attcccttctttctctcttatcagtagtgttgaatataatcatggctatggctgcctctctcctagcactattcttatccttgaccatagcaatagcagttccggcaatggctcaaagcggatggaactctgcccatgccacattctacggtggcagcgatgcttccggcactatgggaggtgcgtgtggctatggaaacctgtacagccagggctatgggaccaacactgctgcattgagcaccgctctcttcaatgaagggatgtcatgcggggcatgcttcgagatgaggtgtgcagatgatcctcagtggtgccttcctggatctgttattattactgccaccaatttttgccccccaaacaatgccttgcctaataatgccggaggctggtgcaatcctccccttcaacatttcgacatggcgcaacctgccttccaacaaatcgccaagtacaaggcaggcatcgtgccagtacagtacagaagagttccctgcgagaagaagggtggcatgcacttcacagtgaatgggcattcatacttcaacttggtgctgctgagcaacataggaggtgcaggggatgtccatgctgtgtcaataaaggggtcgaagacaggatggcaagcaatgtctcgcaactggggacagaactggcaaagcaacgc

SEQ ID NO: 7082 - DNA, 712 bp, Artificial
  Synthetic
tttccttttccttttccctcttctctctctgtttacttgttcacacactgaatcactatagtgtgtgagaaaatggctgtaactaagatactctgcattgctactactcttttctgttttctcaccgccgtcaatgcaaaaatccccggcgcttacaccagtggcccctggcaaggcgcccatgccactttctatggtggctccgacgcctctggcactatgggtggagcttgtggatatgggaatctgtacagccaagggtacggagtgaacaatgcagcactgagtacagtcctgttcaacaatggactaagctgtggagcttgctttgaaattaagtgtgttgacgatggaaaatggtgccttcccggtaacccatcgattttcgtcacggctactaacttttgcccaccaaatttcgctttgccgaacgacgacggtgggtggtgcaacccgccacgtcctcattttgacttagctatgcctatgtttctcaaaattggtcagtaccgtgccggaattgtccccgtcacttaccgccgagtaccatgccggaaagcaggagggatccgattcacaataaacgggttccgttacttcaatttgctattggtgacaaacgtggcgggtgcaggggacatccagcaggttcttattaaaggtacaaacacacagtggatagcaatgagccgaaactgggggcaaaattggc

SEQ ID NO: 7083 - DNA, 909 bp, Artificial
  Synthetic
acattttcgttaaaaaatgggtattttaatacttctgtttatgggaatttccctcatgtttcaatctgtttatggttattatggtggttggatcaatgcacacgcaacattttacggtggaggcgatgcttctggaacaatgggtggggcttgtggatatggaaatctatatagcacaggctatgggacgaacactgcggcgttgagcacggctttgttcaacaatgggttgagttgtggagcatgttttcagttaaggtgtgtcaatgctcgacagtactgcttgcctggcacaattactgtcacagcaacaaatttttgcccaccaggtggttggtgtgaccctcccaatcaccattttgatctgtctcagcctgtctacttgcgcattgctcaatatagatctggcattgttcctgttgcctaccgaagggtaccttgtagaagaaggggaggaattagatttacaatcaatggtcactcttacttcaacttagtacttgtgaccaatgttggcggagcaggagatgtacgatcattgtacatcaagggatcaagaactcagtggcaaccaatgtcaagaaattggggccaaaattggcagaataacgcttacctcaatggccaaagcttatctttcaaagtcaccacaagtgatggtcgcactgtagtttcttataatgcagctcctcgttcctggtcttttggccagacttttactggaggccagttccgttaatatcaaattttttcaagtatagtgcttactatatatttaatttaaatattattccaagagttggccttaatggcttttactcaccataatttaagaaaaaaaaaatggcactttttgcttggccattcaattgtggaagaaaaggaattgattcggcctacttttttttg

SEQ ID NO: 7084 - DNA, 279 bp, Artificial
  Synthetic
ctcgagcttgcggccgcgtttaggccttgtggtttagctaatggtcacgctacattctatggaggaagtgacgcttctggaacaatgggtggagcttgtggttacggagatctttactcggcggggtacgggacaatgacggcggcgttaagcacgggtctgttcaacgacggagcttcttgcggagaatgctataggataacgtgtgatcacgcggcggactcacggtggtgcttgaaaggagcttctgtggttattacagccactaacttttgccca

SEQ ID NO: 7085 - DNA, 378 bp, Artificial
  Synthetic
gcgagattactaaaactcccagctttttccgtctgcgttcagggcggctaccgtcgtggcggacaccatcccggcggtcacatgggaccttggatcaacgctcatgccactttttacggcggcggtgatgcttccggcactatgggtggagcatgcgggtacggcaatctgtatagccaaggttatggactggagacggcagcgctgagcacagcgttattcgaccaaggacttagttgtggcgcatgttttgagctgatgtgtgtcaacgatcctcaatggtgcataaaaggccgatccattgtggtcactgccactaacttttgtcctcctggtggtgcatgcgaccctcccaaccaccatttcgatctttctcag

SEQ ID NO: 7086 - DNA, 725 bp, Artificial
  Synthetic
cttttcgtttgagtcatctgagccttgcactgagccttgtggctcttgcacttgcaggtgttgccatatataggaacacttatgaagcgatgagtaaaggattccaaacactttctccagagttagatctgctggggtcagcagccagcattttaaccctaaataatgctgagcaaaattcagacagcaagttaactcaaccattacctccatccgcatgcatcttctcggctgttcgagcagttgtcaacagtgcaattgatagagaaagacgcatgggagcttctctcattcgtctccacttccatgactgctttgttgatggttgcgatggaggagttcttctagacgatattcccggatcattccaaggggaaaaaacttcaccacccaacaacaactcagccagaggttttgaagtcatagaacaagctaaacaaagagtaaaaaatacttgtcccaacacacctgtatcttgcgcagacatcttagctattgctgctcgggattctgttgttaaactaggaggacaaggctataacgttgcactagggagaagagatgcaagaacggccaacttcactggtgctttaactcagcttccagctccgttcgacaatctaaccgtccaactaagaaaatttaatgacaaaaactttaatgcccgggaaatggtggcgctagctggtgcccacacggtgggtttcacaaggtgcgccaccgcg

SEQ ID NO: 7087 - DNA, 681 bp, Artificial
  Synthetic
gaccagtccaacatccagtctttttcttctttttctttttattccttcattgttacagagaacaaattagaaagctgtctgaaacaccagaaatatatggagaaactacaaatgtatgttaaccaaacactatgtttatacaaatacaacaaacttttctttcttggtttcttgtgtttgttaacactctttccaacttcatcttcaaacctttccttcgatttttatgcactgtcttgccctacagctgaattcatggtgaaaaatacagtgagatcagcttcctctatggacccaacactccctggaaaacttcttcgtctccttttccatgactgttttgttgagggttgtgatgcatctatacttttagaaggaaatggaacagagagaagtgatccagcaaacaagtcacttggaggattctcagtaatagaatctgcaaaaagagtattggaaatcttttgccctcgaactgtttcttgtgccgatattattgcattggctgctagagatgctgttgaattcgcaggagggccaaatgttcaaattccaactgggagaagagatgggaaaattagtttggcttcaaacgtgagaccaaatatagtggacacaagtttctcaatagatcaaatgattgatatattttctgcaaagggattgtctttggatgatctt

SEQ ID NO: 7088 - DNA, 803 bp, Artificial
  Synthetic
ggtgtccactacttcaagttttctacttcttgttcttgtttcttcttcattgtttttatcagaagctcagatacctgctccagttaagggtctttcatggaagttttatgaatctagttgccctcagcttgaatccattattaggaagagacttgaaaaacagatcaaggatgatgttggccaagctgctggcttacttcgtcttcatttccacgattgctttgttcagggatgtgatggttcagtgttgcttgatggatcggcaggagggccaagtgaacagactgcaattcctaatttgaccctaagaaagagatcattcaagataattgatgatcttaggaaaagggttcacaatgcatgtgggaaagttgtgtcttgctccgatattacagcaattgctgctagggactctgttgtcttgactggtgggccaaactacaaagtgcccttaggaagaaaagacggacggacctttgcaacagaacaagcaaccttagacaaccttgttgcaccatttgccaataccacagtcgtcctccgtcgccttgcagccaagggtttagacgccaccgacgccgtcgctttgtccggggcccacactatcggaatcagccactgtacttccttcaccgaccgtctcttccctaaccaagacccaaccatggacaaaacattcgccaacaaccttaaacgcagctgccccacagctgattccaacaacactgtcaacatggacattcgaagccctaatgtattcgacaacaagtactacgttgatctcatgaataggcaagggctat

SEQ ID NO: 7089 - DNA, 657 bp, Artificial; identical to SEQ ID NO: 4
  Synthetic

SEQ ID NO: 7090 - DNA, 608 bp, Artificial
  Synthetic
taaagggctagttataagaaatgggaaagtatgagttgttagtggtgatattgtcgatggatataatagttagtggagggaggtttgatggaggtggatatgggttcgtagatggtctaaggatggaatactacgtgatgagttgcccatttgcggagggaatagtgaaaaacactgtcaacaggcatttgcaagctgatcccactcttgctgctgcccttgttaggatgcacttccatgattgcttccttcagggatgtgatgcatctgtgttgatagattcaacaaagggtggtaacacagcacaaaaggactcgccagcaaatttgagcttgagaggctatgaaatcatagacgaagccaaggaagagctctaaaatcaatgccctggagtcgtctcttgtgctgatattcttgcaatggctgctagggatgctgccttctttgctggaggtccggtgtatgacataccaaaaggaagaaaggatggaagaaggtcaagaatagaagacacaattaatttaccttcccctgctctcaatagttctgagcttatcagaatatttgcccaacatggtttcagtgctcaagaaatggtggccttatca

SEQ ID NO: 7091 - DNA, 339 bp, Artificial
  Synthetic
cccacgcgtccgtgcggctccaaacgcaaactcggctcgaggatttccagtgatcgatagaatgaaagcagcagtagagacagcatgtccaaggactgtttcatgcgcagatatacttaccatcgcagctcaacaagctgtaaatttggcaggaggtccttcttggagggttcctttggggagaagagatagcttacaagcattctttgctctcgctaatacaaatcttcccgctccattcttcactctcccacaacttaaggccagttttcaaaatgttggacttgaccgtccctctgatctcgttgcactctctggtggtcacacatttggtaaaaa

SEQ ID NO: 7092 - DNA, 625 bp, Artificial
  Synthetic
cccccccgaaagcaagcaattattcaacggttcattatttcaattgaagctccccttcctcaaatttcgaagaatgaagagtttttcaagtaccgccactttgctttcactcacggccttctttcttgtggccttcatttctgctttaccatttgacgatatcgaccttccttctaagtactatagccttagctgtcccaagcttgaggaaattgtccacaacaaaatggaggaatgggttaaaaaagattatactcttgctcctgccctcatgagattgcatttccacgactgcgttgttaggggatgtgatgcttcaatactattagaccacgaaggaagtgagaagagtgcaaaagcaagcaagacattaaggggatttgaggtaatagaggatatcaaaagagaagtggagagagtgtgcccaaggacagtgtcgtgtgctgatattttaacagtagctgctagagacgccacacttgctgtaggtggtccattttggatggttcctatggtaggaaagatggtacagtttcatatgctaaggaagctgatcaattagtccctatgggtcacgaagtcgtcactgatttgcttgagcttttccagtctaagggcttgaatg

SEQ ID NO: 7093 - DNA, 612 bp, Artificial
  Synthetic
ataagtgcaaagaaagacaagcttaatttggcaaacgtaagtagttattatggcagtaacaagttcatgtcttattgctctagtccttgcttttgcgttgttttccagtagtacagtgaacgcactgagctccaattactatgacaatacatgtcccaaggccgagtcgaccatcaccaaagtcgtgaagaaagctatgttgaatgacaagacagttcctgctgcacttttaaggatgcacttccatgattgtttcgttagaggttgtgatggctctgtgttgctggactcaacaagaaacaacaaagcagagaaagatggcccccctaatattgcattgcacgcattctatgtcatcgacgctgttaagaaacaaatcgaagatttgtgccctggaattgtctcttgtgctgatattttggctctcgctgctcgggatgctgttattctttccggaggtcctacttgggatgtgccaaaaggtagaaaagatggaagaatctccaaagccactgaaacccgacaattaccttctcccacattcaacatttctcaactgcaacaaaacttcgcccaaagaggcctttctttggatgatttagttgcgctttc

SEQ ID NO: 7094 - DNA, 666 bp, Artificial
  Synthetic
  misc_feature (3)..(3): The residue at this position can be any nucleotide.
ggngaaaaaagctagtacaaaatttacgtactcaaagaccatatatagctgaaacatagaaaaataaatttaaagaccatcgttgaaacagtagtattatgagttatagttccctaagcaaattactaaccatgattatggtccttgtcctgctatccatgtctacgaacatggtacaaggccaaggtacccgtgttggattttattctagtacgtgccctggagtcgaatccatcgttcaatcaacagtgaagtctcattttcagtctgatcaaacgttggcaccaggactgctgagattgcacttccacgattgtttcgtacaaggctgtgatggttctatcctcattgatggttcagacgctgagagaactgccaccgtgaatggcggcttgagaggattcgaggttattgatgatgctaagaaacagattgaagctgtttgtcctggagttgtctcttgtgctgacattcttgctcttgctgcacgtgatgctgttgtcttgaccaacggagcaagttgggctgtgccaacgggacgtagagatgggcgagtatcatcagcatctgatgttaataactttccaagtccttctgattccgttgatgttcaaaaacaaaagtttgctgataagggtctcaccactcaagatcttgtcacccttc

SEQ ID NO: 7095 - DNA, 351 bp, Artificial
  Synthetic
cccacgcgtccgtgcttagaatgttcttccacgactgcttcgttcggggatgtgacggatcagttttgttagataaaccaaacaatcaaggtgagaagagtgcagttcctaacctaagtcttcgagggtttggcatcatagacgattccaaggcggctctagaaaaagtgtgtccgggaattgtttcttgctctgatatcttggcacttgtcgctagagacgcaatggttgcacttgaaggaccatcatgggaagttgaaacgggaagaagagacggtagggtttctaacatcaacgaagtcaacttgccatcaccttttgataacatcaccaagcttatcagtgattttc

SEQ ID NO: 7096 - DNA, 730 bp, Artificial
  Synthetic
  misc_feature (652)..(652): The residue at this position can be any nucleotide.
gtttgtaatattagcgctgctcttttgtttgattctttctctttctgtatttgctgaggcttcgtcgaagaacaaacataagcccaaaccaaaaaaatcaacgtttggtgttggattctataaaagatcatgtccagctgctgaggccattattagaaaagctgtattcaaagcggttctgaagaatcctggcactgccgctggcattattcgcatgcatttccacgattgctttatcaggggttgtgatggttcagtgctgctggattcagtaagaggaaaggaaacggctgagaaagatagtcccattaacaacctaagccttcgagggtttgaggttattgatgaagcaaaagcacggctggaaaaactatgtccgcgcacagtttcgtgcgcggacatactcgcctatgctgcaagagatagtgccttgttcgcgggaggcataagctatgctcttccaggaggacgtcgcgacggccacgtttcgttgagctccgaagtcattcaaaacctccctccacctttcttcaatgcccaacaacttcaagacaacttcaaaagaaaagggttgtcacttgatgagatggtgactttgtcaggggctcattctattggtcgcactcattgctcttcattctctaatagactntacggtttcaatgctacacatcctcaagatccttcccttgatcatagatatgcttcattcttgaaaaataagtgtcct

SEQ ID NO: 7097 - DNA, 774 bp, Artificial
  Synthetic
tgcccacaagcaaaagaaatgtcaagtctgttgttgctaaggctgtaggcagagaagctcgaatggctgcctctttgctcaggctccattttcatgattgctttgttaagggttgtgatgcatcactacttctggacagcagtggaaccataataagtgaaaaaatatcaaacacaaacaggaattcagctcgtggatttgaagttattgatgagattaaatctgcaatagaaaaggagtgccctcaaactgtttcttgtgctgatatcttggctcttgctgcaagggattctacagttttagctggtggaccaagctgggaagttccattgggaagaagagactccagagatgctagtataagtggctccaacaataacattcctgctccaaacaacaccttcaataccattctcacaaaattcaagttgaaaggacttgatcttgttgaccttgttgctttatcggggagccacacaattggaaatgcaagatgtaccagcttcaggcaaaggctctacaatcaatcaggcaacagtttaccagactatacattggatcaatcatatgctgctcaattgcggacaagatgccctaaatctggtggtgaccaaaacttatttttcatggattttgtttcccctacaaaatttgacaactactacttcaagaacttgttggcttcaaggggcttgtttaattcagaccaagttcttgtgactaaaaatcaggcaacattagccttggtgaaactgtatgcagaaaacaatgaca

SEQ ID NO: 7098 - DNA, 683 bp, Artificial
  Synthetic
attactaagcaaaaaatcatagtacaagctgctattgagccttaaaaaaatggattccaagagcttcaacctttcagcttttgcacttttagcttgcctgattttatctttttcagtatcatctcttgcctatgggaaacaaacaacatggccaccacttagagtaggtttctacagttatagctgtcctcctgctgaaacaattgtgaagaatgttgtatacaaagccgtatcgcgtaatccaggaattgctgctggccttatcaggctacattttcatgactgcttcgtcagggggtgtgatgcatcagtattattggatggaccaaactcagagaaggaaggtattcctaacaagaacagtttacgtggtttcgaggttgttgatgcagcaaaagcacaacttgaggctgcatgccctggaattgtatcctgtgctgatattcttgcctttgctgctcgggacagttcctataaagttggtaaaatatactataatgttgaagctggacgtcgcgatggtcgcatttccattgattccgaaacattaaccaatcttccttctccattcgtcgatgccaaggaactcgtcaagagctttgctagaaaaggtatgtccgctgatgaaatggtgacactatctggtgcacattccattggtattgctcactgcgctgtttttg

SEQ ID NO: 7099 - DNA, 642 bp, Artificial
  Synthetic
cacacaatcggattcgcccggtgcgccaacttccgggacaggatctacggcgactacgagatgacgaccaagtacagcccgatctcccagccctacctgagcaagctcaaggacatctgccccctggacggcggcgacgacaacatcagcgccatggacagccacaccgccgccgccttcgacaacgcctacttcgggaccctcgtcaacggcgagggcctcctcaactccgaccaggagatgtggtccagcgtcctcggctactccacggccgacaccgtcagcaagtactgggccgacgccgacgccttcttcaagcagttctccgactccatggtcaagatgggcaacatcaccaaccctgcaggtggtgaggtcaggaagaactgcagatttgtcaacacatgatcatatgcatgctcaatcaaaaggactgcacatttgttctttttaatttgatggctggcttgtcctagatagaaataagaaatgctttgatgatgaggcccttgtactggtacatataatacgcgttgttgtcattttgtcatcactctacaagtatgttacatggagatacacatgataaggtactcctggcttttgcacaaactttttatttatatacatgatgaggaatgg

SEQ ID NO: 7100 - DNA, 529 bp, Artificial
  Synthetic
ggcatcagcaatggcgtcgtcccagtcccatctggatctggtacagctgctaatcgttgtggtgatgactatgacgatgctggtgggtggcggcgaggcgctgagcctggactactacgccaagacgctgccccaaggcggaggcggcggtggcggcggcggtgaagcaggccatggccaaagaccgcacggtgccggccggcctgctccgcctgcatttccacgactgcttcgtcagggggtgcgacggttccgtgcttttggactcgtcggggaacatgtcggcggagaaggacggcccacccaacgcgtcgctgcacgccttctacgtcatcgacaacgccaaggccgccgtcgaagccctctgccccggcgtcgtctcctgcgctgacatcctcgcgctggccgccagggacgcagtcgccatgtccggtggtccttcttggcaagtgccggtgggtcgtcgtgacgggcgcgtgtcgctggcgagcgagacgacgacggcgctaccggggccgacggcgagctt

SEQ ID NO: 7101 - DNA, 498 bp, Artificial
  Synthetic
caccgacttaacacttggtcatttctcattggtgcgtcacggagtgagcagtgtacatacgttactagctcaaggctgcagcggagagagagagagagagagagagatgggcgctgtggctgcggttcgtgccgcggtcctggtcgtggccgtggccctcgccgcggcggcggccggcgcgtcggcgcagctgtgcgacaagtactacgacgggacgtgcccggacgtgcaccggatcgtgcggcgcgtgctgaagagggcgcggcaggacgacccccgcatcttcgccagcctcacccgcctccactttcacgactgcttcgtccagggttgcgacgcgtcgatcctgctggacaacagcacgagcatcgtgtcggagaagttcgcgacgccgaacaacaactcggcgcgggggtacccggtggtggacgacatcaaggcggcacttgaggaggcctgccccggcgtcgtctcctgcgccgacatcctcgccatcgc

SEQ ID NO: 7102 - DNA, 647 bp, Artificial
  Synthetic
gagagagagaaaagaagaagaagaagaagaagaagaaggagaaagagagagagagagagagatgggaatgagaatggggatgggaatggtagtagtggtgttgggtatggtgatgatagggcaagcatgggggcagttaacagctgatttctactcgagtagttgccccaacgtatcagccattgtaggagaagtggtgaatgcagctgtcgctgctgagcctcgaatgggggcctccttgctccgccttcacttccatgattgctttgttcaaggatgtgatgcatcattattgttggacgaccccaatggagaacaagtagcgcttcctaatttgaactcaattagaggacttaatgtggtggataatataaaggcagcagtggagtctgtttgccctggcattgtctcttgtgcagatattcttgctattgccgcagaaagatctgttgttgcactcaaaggttctagttggccagtgctattgggaagaagagatggcactacctttgcatcaaatgctacggtactccaatctctagttgcgcctacagagaacttatcctccatcatccaaaaatttgctaatgtgggacttgacactaacgatgtggttgttttatcaggggctcacactattgggcgtg

SEQ ID NO: 7103 - DNA, 475 bp, Artificial
  Synthetic
aaaggtttcttttgagagagaggaaaaaatggcttcatttagctatttgagtattctggttttatgtattcttggaatagtaagttctggacatgctcaattgcagcttaatttctatgccaagagctgtccaaatgcagagaaaatcattttttactttgtccaaaagcaagttcccaaagctccaaatactgcagctgccatacttagaatgcatttccatgattgctttgttaggggttgtgatggatcggtacttcttaatttcacttcaagtacaggaaaccaaactgaaaaacaagctaatcctaatctaacattgagaggtttctccttcattgatgctgttaagagattagttgaagctgaatgccctggagttgtttcttgtgctgatattattgccttggttgctagagatgcagttgtagtcacaggaggtcctttttggaatgtgccaactggtagaagagat

SEQ ID NO: 7104 - DNA, 611 bp, Artificial
  Synthetic
aattaagagagttagcctttgatttgcctttggtagtaagaaggaatggctagtcccaactacaattgcaagtacatagtgatggtactccttcaagtcctgtattggagttgtaagggtgatgctcaatccctgagctccaccttctatgccaccacttgccccaatgttacgtccattgttaagggagttgttgaacaagtggttgatcaggatcctagaatggcagcttccttgttgcgtctccatttccatgattgcttccccaatggttgtgatggatcaatattgctagacgacacatcaacatttacaggggaacaaactgcaccccctaataacaactccattcgtgggatggatgttgttgatgatataaaggctgctatagagtcagtttgtccaggagttgtctcatgtgcagatatattggccattgcttcagaagttggtgtttcttatttcttctagggaggagggatggcaccaccgctgcaacaactcaacaagtaatagatgctcttcctgctccaactgattctttggatacaattaagagcaagttctcaaatgtgggccttaacacacaagatgttgttgttctttctgga

SEQ ID NO: 7105 - DNA, 634 bp, Artificial
  Synthetic
agtgtggtgtaggaactaagattgttaggaatttgccttgctttggtttggctttggtaggaagaaggaatgggtagccccatggacaattgtaagtacatagtgatggtactcctccaagtcctatattggagttgcaaaagccatggacaatccttgagttccaccttctatgccaccacttgccccaatgtcacttccattgtccagggagttgttaaacaagcggttgctcaagacgctagaatggctgcctccctcttgcgccttcatttccatgattgcttccccaatggctgtgatgggtcaatattgctagacgacacatcaacgtttacaggggagcaaactgccccccctaataataactctattcgcgggatggatgttgtggatgatataaagactgctgtagagtctgtttgtccaggaattgtctcatgtgcagatatattggccattgcttcagaagttggtgtttcttatgttgggggtcctacatggaaagttcttctagggaggagggatggcaccaccgctgcaacaactcaacaagtaatagatgctcttcctgctccaactgattctttggatacaattaagagcaagttctcaaatgtgggccttaacacac

SEQ ID NO: 7106 - DNA, 665 bp, Artificial
  Synthetic
ttcacttagtgcttcttgtgtctgtcatttcgacaagtagttgtgttaatgctcagctccagtgggacttctatcggaattcatgtccaaatgtggagtccatcgtccgatcagcagttgaagacaagtttaaacagacaattgttacagcagcagcaacacttagactctttttccacgattgctttatacagggctgtgatgcttccatcatactgaggtcgtcaggaaataacacagcagaaaaggatcatccagacaatctgtcccttgctggagatggatttgacactgttattaaagccaaagctgcagttgataatgtgccttcttgtaagaacaaagtctcttgtgctgatatcttggccatggccgctagagatgtcattgcattggcaggaggaccgcactatgctgttgaattaggaaggagggacggcagaatgtcttcacaaactagtgtgcagaacaacctgcctcactctaacttcgacttacagaaactccttcctatgtttgcctctcgtggactatctatcagacatttgattgccctctcaggagcacatacactaggattttcacattgcaaccagttctcaagcaggttatacaactttaacagcacacacaaggttgatccaacaattgatgtaacctatgct

SEQ ID NO: 7107 - DNA, 599 bp, Artificial
  Synthetic
acgatgaagctcgaaagcttgctcgttcttgttcttgcgattctaaagacctcacactgcgctttgaggcaaaacttctacgcggactcatgtcctgtcgccgaagctctcgttcagttctccgttgctcaggcagtggcgagaaaccccggaatcgcggctggacttctacgtctccacttccacgactgctttgttcgaggatgcgatgcctcggtgctgctagattcaaccgggaacaacaaggccgagaaggatgccattccaaacttcggtcttcgaggattcgaagttatagacaatgcaaagtccctgctcgaggaccggtgtccaggaaccgtgtcttgtgccgatatactaacgtatgctgctcgcgacgccgtcttccaggttggcggacctcgctgggaagttgaaggtggccgacgagacggatcggtgtctatagcggatcaagtcggggctaatctcccgtcgccgctcttcaacgtcgatcagctgacgagaagctttgcccgcaaaggaatgacacaagatgagatgataactctctctggagctcacacgattggagtcgcgcattgtctatccttcgtcaa

SEQ ID NO: 7108 - DNA, 637 bp, Artificial
  Synthetic
ctcctgctcctcctcgccgtggcgctggcgctggcggcgcgcgcgcgggcgcagctgtcgccggggttctactcggcgagctgccccaccgtgcacggcgtcgtgcggcaggtcatgtcgcaggccgtcatgaacgacacgcgcgccggcgccgccgtcctccgcctcttctaccacgactgcttcgtcggcggctgcgacgcgtcggtgctcctcgacgacacccccgcggcgcccggcgagaagggcgtcggccccaacgccgtcggctcgacgaccgtcttcgacctcgtcgacaccatcaaggcccaggtcgaggccgtctgccccgccaccgtctcctgcgccgacgtcctcgccatcgccgcgcgcgacagcgtcaacctggtcagtcacacacactccacacacacgcgcgcgcgcgcgcgccatgtgttcgacgcaatgacgcaaaccctgttgtgcgcacgtgtgcagctcggcgggccgagctgggcggtgccgctcggccgccgcgacgcgctgtcgccgagtcggagcgcggtgtcgaccgacctcccgggccccgaggccgacatctccgcgctcgtctccgccttcgccgccaagggcctgagctcgcgcgacctcgccgcgc

SEQ ID NO: 7109 - DNA, 680 bp, Artificial
  Synthetic
gagtacgacgagagctaagtaaacttagctatatcgatcgaccatggcgtccaggactagtgctactgccggcatgctgctgctcgccgccgcggctgcgctggtgtgcagctcggcggcggcgaggatgccgccgttggcgaaggggttgtcgttgggctactacgacgcgagttgcccgcaggcggaggccgtcgtgttcgagttcctgcaggacgccatcgccaaggacgtcggcctcgccgcggcgctgatccggctccacttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgagctcgtcgccctctccggcgcgcacaccgtcggcatcgcgcact

SEQ ID NO: 7110 - DNA, 599 bp, Artificial
  Synthetic
gtgttgtgcgtctcagctttccagcggccatctttgattgacgatgccgcaaagtttggcgcttttggttgtcgtgacgatcgcgctgctgagtgctgctcaagctcagctctcgcccgatttctacagcaggagctgtccgcgagtggaatccatagtccagcgcgttgcgatcgagaaattcaggcaggcaccgacgtctgcggcagccacagtccggctcttcttccacgactgctttgttgagggatgtgatgcttcggtgatgttggcctccactccaggaaacaaggccgagaaggacgcagacatcaacaaatctctagctggagacgcatttgattcggtgataagagctaagaaagccgtggaagcagagtgtcccggcgtagtctcttgtgcggatgttctagcgatactaacgcgggactttgtgcgtctgacaggaggaccaacttggcaagtaaagcaaggaagacgcgacgggagaatctccagctcgcaatcagctgctgccaatctccctggttcggaattctctgtaaaccagcttcggaaaaactttgcagccaaaggactcaatctagtcgatttggtgt

SEQ ID NO: 7111 - DNA, 652 bp, Artificial
  Synthetic
cgaaagaatttctttgtgggagcagtcggagagagaatgacgagaattaaaacttctactgtcttcttactgatcattttcgctgtggcaatggttgatatgtgccaggctcagctctccactacattctactccaagtcctgcccgaacgtcaagaaaatcgtcaagacagcaatggaaaagaaattcaaagaggccagagttgtagctgctggaatgcttcgactcttcttccacgattgcatcatagagggatgcgatgcttcggtgatgattgcctcaaccagcgggaacaaagctgagaaagacgccgatgacaatctatcgctcccgggagatgctttcgacgctgtcatccgagctaaggccgcagtagacaaagaatgccggaacgtcgtctcctgctcagacattctcgtcatggcgaccagcgaactcctgaagctcattggaggccgcggctgggacgtgagactggaaggaaagacggcagaaggtcgcgggcttcagcagttcccgggaatttgccgggcgtaaacatgacggttgctcagctcacgtcgttcttcaagaaccgaggcttcagccaaagagagatggtcgtgctgtccggaggccatagtgccggcttcgcacactgcgacaagttcat

SEQ ID NO: 7112 - DNA, 1039 bp, Artificial
  Synthetic
  misc_feature (243)..(243): The residue at this position can be any nucleotide.
gtgggaaggtataagcataagcaatgggtttgagagaagcagtcctaatctctttgatggtcctagtgttggaggcaagatggtgtgagggtgggggtgaggggttgaggatggatttctatggggagaaatgcccatcccttgagcagatagtgaaggaggaagtcaatgctctctacaacatacatggcaacacggctgtctccttccttaggagcatattccatgactgtgccgtccagnggtgtgatgcttccttgccattggactccacagctgagcgtgcatcagagaaagagtcaattagaaaccttggcatgcgcaattacaagtatgtccactcaattaagaaaacagtggagaaacattgtcccaacacagtctcatgcgctgacattctaatgcttgctggtcgagaaggtgttatgatgcttggtggcccatatattcccatgaaattgggacgaagagatagtttgactagtagtaaagaagaagctgatgctcaacttccggaaccagatatccaagtctcttctctcttgccttatttttcttcaatgaatcttcaaactactcacgttgtggcattactaggtgctcacacagtggggagaacacattgcactaacctagtgccccgtttgtacccaaataccgaccccctcttggactctgcatatgccggctaccttaagttccgttgtcccacatccaatcctaacccccatgaagtgttgtatgcaagaaatgaccgcaagacacctatgcgctttgacaacatgtactataagaacataatggccaacaagggactcctcaaggtggatcaattcatctcaatggatgaccgaacctctaaagaggtagaacggatggccaataaccaatcctacttctttgaaaaatttgttgaggctgtcggtattcttagtgagcacaaaactctcaccggtactcaaggagagatacgccgtcattgccaatttagtaattaatctcccatctaaacctccccatgatgtgaagtatttgtata

SEQ ID NO: 7113 - DNA, 711 bp, Artificial
  Synthetic
atgaccagtaagtatgtgtggctactaaatggcttccatgtctcagcagcagcttcttgtcggtctttttctacttctcattgcggcattgtgttcttcatcttcctctgcttcttcgcttcacagctatgctcagtcttgtccgagagccgagcaaatcattgccgacactgtgagggaagcggctgacagagatccaaccacccccgccggcattatccgcttgttcttccacgactgcttcgttgagggatgtgatggatctctgctgttggaatcgacacccaccaatggcagggacgtggagatgtttgcactcgggaacaacaactctgcgcgtggtttcgagatcattgagttggcgaagacccggctggaggctgcctgcccggggaccgtgagctgcgcggacacgctcgccattgctgccagagacgccacaactcgctttggaggacctttctatactgtgcctacgggtcgcttcgacggacgggtctcgagcaggacgttggccgacgcacgactgccgggtccctccttcacttttgttgagctgagagacaacttttgggagaaacgcttgtcggtccatgatctcgtcgtcctctctggtggacacaccattggtcgctcgaagtgcaggttcttcgaacaacgcgtctacaacttcagcaacaccgggaatccggatccaactctggaagcttc

SEQ ID NO: 7114 - DNA, 665 bp, Artificial
  Synthetic
gagcgatcatcagttttatcatccctttctatctagagcatacgttctttcctagctttgatcatggccggttctggatcaaggcagtggtcgcttctggtcgcggtgacggtgatgggaatcatctctgcaaatgcgcagctctcctctagcttctactccagcacttgccccaatctcactgatatcgtgaggaacgtcatccgatccgcggtgtcgagcgagagccgaatggcagcatccattctccgcctccacttccacgattgcttcgtcaatgtaagtaagcttcaaagaaactctccaattcaaatttcaagattatgcgctgaatattcgtcccgtttgaaaccacagggttgtgatggatcacttctcctagagggcgcagagcgagacgccattccaaaccgcaactcggcgagaggattcaacgtcatcgacaatgtcaaatccgccgtagagagctcctgtccgggagttgtctcctgcgcagacatcctcgcattgagcgctcatgaatcggtcacagcacttggaggaccttcatggactgtggtgtttggccgacgagacagcctcacagccggtagcgctgcgactgcgaacgcaaacatccccggcccgaacttcactgcgtccgcactcgtctccaacttccagaa

SEQ ID NO: 7115 - DNA, 620 bp, Artificial
  Synthetic
ggcagcggcagtattcgtgattgcagtgttgctgtctctgcatggcagtgctttcggccagctgagctcgaccttttacagctcctcttgcccgaacctcatcaacatcgtgagaaacggcgtccggcaggcagttcaagcagaggctcgaattgctgcctcgttcgttcgactccattttcacgactgttttgttaatggatgcgatgcttctatcctgctggatggctcaagtctggagcaaaacgcattcccaaacgtcaactctgccaggggttttgacgttgtggattccatcaagagctccgtcgagagctcgtgtccgggcgttgtttcttgtgccgacttgctagcactcatagctcgagaatccgtcgtcgcgctcaatggaccttcgtggactgtagtgttcggaagaagagacagcttatcagcgagccaggctgcagcaaatgccaatcttcctccaccgactttcaacgcctccgcactcatcgctaactttcagaaccagggactttcagcgacagacatggtagctctctcgggtgctcacactattggacaggctcaatgcagaaacttcagagctcggctctacggaccgttccaagccggcg

SEQ ID NO: 7116 - DNA, 711 bp, Artificial
  Synthetic
tcatctcagtcgtgtcttgtcattattactcgacccagtccgtgcaagtccacgccttgctcggcaacgatagcgagtatgtcggcgcaagacacgactccgggacaagctccttcgaccgctgctttgatggcatctacaacctcgaagcctctggcggaattcctgttcggattcgcggtcttctctccggtgaagcccggctggtcgtccagaagaacagatccatcaaatccctgatcaacaagaaaagagaaccaaggataatcgtcaacttctcatcaccaggcgtaaaagcgatgccgccatccttggttctcgctccactggtggtctcaggacatctttcacgatcgacaacacattgggacaggagtaggcgtagaaagtggggctcagctgctgtggagacgaggaaggatgtgccgacacacaggaaaaggggagaagggaattatgcaagagtcatcatcaacagcgcagccttcgtcgtcttcgtcgtcgatgcattcatctttctcatgctggaagaagaagaacgaagaagaagaaggaagacgaggaggaagagttcggggtaacggtgtccaaagtctgggaggctatatagtgaaactttcacgggcaagattgacacggtctggcgtggtgacctggtctcgtcaagattttcaacaccaaccaccactatgtcgaaataactatattatt

SEQ ID NO: 7117 - DNA, 541 bp, Artificial
  Synthetic
tatctgaaagatggtgctggatagatcgaaggacaagtttaagatggtgaagacgggagcacaagtttaagattgatggatcaaaaagaagttggaggtgaggatggcggagatagatcgatcaagcgacgtcaagatggtactcaagaagaaggagagtttctggacgtaccaatgcgaccgagtctcgggcagccagtgtcaagatatcagcgcaggagacgattcctccgcagtgggcctcgacactggccttgatcgagtcgatgacttcgaatcctcggagagagttcgcattcggccccgcatttttctcgcctttgaacgtcttggtgtcatcgagcagcaccgaggcatcgcatccctgcggaaaaaatttcgattttttccttctttccggtgggaaacttcgaaacaaatactacgaaagctatcctgcttagtggattgctggacttacattgacaaagcagtcgtggaaatggaggcggagtagcgatgccgcgatcctcggctcatgcttgaaagcgctctccacgcc

SEQ ID NO: 7118 - DNA, 576 bp, Artificial
  Synthetic
gcgatcatcagttttatcatccctttctatctagagcatactgttctttcctagcttctgatcatggccggttctggatcaaggcagtggtcgcttctggtcgcagtgacggtgatgggaatcatctctgcaaatgcgcagctctcctctagcttctactccagcacttgccccaatctcactgatatcgtgaggaacgtcatccgatccgcggtgttgagcgagagccgaatggcggcatccattctccgcctccacttccacgattgcttcgtcaatggttgtgatggatcacttctcctagagggcgcagagcgagacgccattccaaaccgcaactcggcgagaggattcaacgtcatcgacagtgtcaaatccgccgtagagagctcctgtccgggagttgtctcctgcgcagacatcctcgcattgagcgctcatgaatcggtcacagcacttggaggaccttcatggactgtggtgtttggccgacgagacagcctcacagccggtagcgttgcgactgcgaacgcaaacatccccggcccgaacttcactgcgtccgcactcgtctcc

SEQ ID NO: 7119 - DNA, 635 bp, Artificial
  Synthetic
gtctttggttccttctgcttgcttctcttgctggttcgtcggtcggtggagtttgagcctgcgccatggctgtcggcgggagagggagacggccgctgctcctgctcctgctcctcctcgccgtggcgctggcgctggcggcgcgcgcgcgggcgcagctgtcgccggggttctactcggcgagctgccccaccgtgcacggcgtcgtgcggcaggtcatgtcgcaggccgtcatgaacgacacgcgcgccggcgccgccgtcctccgcctcttctaccacgactgcttcgtcggcggctgcgacgcgtcggtgctcctcgacgacacccccgcggcgcccggcgagaagggcgtcggccccaacgccgtcggctcgacgaccgtcttcgacctcgtcgacaccatcaaggcccaggtcgaggccgtctgccccgccaccgtctcctgcgccgacgtcctcgccatcgccgcgcgcgacagcgtcaacctgctcggcgggccgagctgggcggtgccgctcggccgccgcgacgcgctgtcgccgagtcggagcgcggtgtcgaccgacctcccgggccccgaggccgacatctccgcgctcgtctccgccgccgccaagggcctgagctcgcgc

SEQ ID NO: 7120 - DNA, 573 bp, Artificial
  Synthetic
tctaaatccatccatcgatctctcaattaattaacctcaagagagaagtaattaattgagctagctagctagatagtgagataaatagtgatcaatagctaagctagctagcttcgatcgattgatcatgatgaggtcgccgtggatggtgtttgcatgggcggcggcgatggtggccgtggcggcggcgtcgccggtgccgacgaagctgaaggtggggttctacgagcacagttgcccgcaggcggaggagatcgtccgcaacgccgtccgccgcgccgtcgcccgtgaccccggcctcgccgccggcctcatccgcatgcatttccacgactgcttcgtcagagggtgtgacgggtcgatactgataaactcgacgccgggacacgtggcggagaaggattcggtggcgaacaaccctagcatgcgagggttcgaggtggtggacgacgccaaggccatcgtcgaggcgcactgcccgcgcaccgtctcctgcgccgacatcctcgccttcgccgcccgcgactccgcccacctcgccggcgccaccgtcgactacccggtcccctccgg

SEQ ID NO: 7121 - DNA, 655 bp, Artificial
  Synthetic
ggcagcaatggcacgcatgcagggattgtgtttgaggattgtaggcttgatgtgcctaatatggggtggagttacatgcttagctgttgagctccacggcaatagcaatagcaatagcaatggactcgaagtgggcttctacaagcacacgtgccctcaagcagagtccattgtacaatcggttttagagagagccatccaaaggaatgcccgagcggctgcctttcttcttcgaatgcatttccatgattgctttgtccaaggttgcgacgcttcaatcatgcttgatgacactccttctttcaagggtgagaaaactgcagttcctaatctcaattcaatcaaaggatttgatgttattgatgagatcaaaagtgcagtggaggcagcatgcccacatgtagtctcatgtgcagacattctagcgatagctgcgagggactccgtggttctaaccggtggtcctacatgggatgtaccactaggaagaagagatagccgaagtgcaagcttaacaggagctaaccaaaatctcccaccccctacctcaaacgttgcacaactcattcaattatttcaaaatgtaggcctaaatgtacaagacatggtaacgctttcaggtgggcacacaattggaagatcacgatgcacgtcc

SEQ ID NO: 7122 - DNA, 511 bp, Artificial
  Synthetic
aagagatagtactacttttgcaagctcaagcgtggtagttcaatcccttgttgcccctactgagaatttaacatctataatccaaaagtttgaagttgtcggcctttctccaacagatgtagttgtcttgtcaggggcccatacaataggccgtgctcgatgtgtaacctttcaagatcgactatataactttaataacactggaaaaccagatcccactatgaaccctaaacttttagctacattgcgatcgatttgcccacaagcaaatggaaatggaaatgcgttgacaaatcttgatcaaggctcaggagatcgattcgataacaaatatttcctaggtttgaaaaacaattatggagttttacaatctgatcaagaattatattccacacctggagctactgcaattgcctctttggtacacaaatacagctctagccaaatcaactttttcaatgcctttggcatttccatgataaagatgggaaacaacaagcctctccttgga

SEQ ID NO: 7123 - DNA, 1043 bp, Artificial
  Synthetic
atcgatctttgttagctagagtgttgagcaatggcgtccaagctgggtatggttgtgctactgatctcgggcctctttgctgcccgttgcgcggccgtggtgaccaccggcgaacccgtcgtcgccggcctctcctgggggttctatgacacgtcgtgcccgtcggtggagggcatcgtgaggtggcacgtcaccgaggccctccgccgcgacatcggcatcgccgccggcctcgtccgcatcttcttccacgactgcttcccgcaggggtgcgacgcgtcggtcctcctgacgggttcccaaagcgagctgggtgagatacccaaccagacgctgcggccgtcggcgctgaagctcatcgaggacatccgcgccgccgtacactccgcctgcggcgccaaggtgtcctgcgccgacatcaccacgctcgccacgcgtgacgccatcgtcgcctccggcgggccctacttcgacgtgcctctggggcggcgcgacgggctggcaccggcgtcgagcgacaaggtgggcctcctgccggcgcccttcttcgacgtgcccacgctcatccaggcgttcaaggaccgaaacctggacaagacggacctggtggcgctgtccggcgcgcacaccatcggactaggccactgcggcagcttcaacgaccgcttcgatggctccaagcccatcatggaccctgtgctggtgaagaagctgcaggccaagtgcgccaaggacgtgccggtgaactcggtcacgcaggagctggacgtccgcacgcccaacgccttcgacaacaagtactacttcgacctcatcgccaagcaggggatcttcaagtccgaccagggcctcatcgaggacgcgcagaccaaccgcaccgccgtccgcttcgccctcaaccaggccgccttcttcgaccagttcgcacgctccatggtcaagatgagccagatggacgtcctcaccggcaacgccggcgagatccgcaacaactgcgccgctcccaaccgccgctcctccgacctcctcaacgctgccgacga

SEQ ID NO: 7124 - DNA, 584 bp, Artificial
  Synthetic
gcctccacttccatgactgcttcgtccaggggtgcgacgcgtcgatcttgctggacaacgccgggagcgagaagacggcggggccgaacctatcggtggggggatacgaggtgatcgacgccatcaagacgcagctggagcaggcgtgccccggggtggtgtcgtgcgcggacatcgtggcgctcgccgcgcgcgacgccgtgtcgtaccagttcaaggcgtcgctgtggcaggtggagaccgggaggcgcgacgggcccgtgtcgctggcgtccaacaccggcgcgctgccgtcgccgttcgccgggttcagcacgctcctccagagcttcgccaaccgcgggctcaacctgaccgacctcgtcgcgctctccggcgcgcacaccatcggcaaggccagctgctccagcgtcacgccgcggctgtaccaggggaacaccacctccctcgacccgctgctcgactccgcctacgccaaggcgctcatgtcgtcgtgccccaacccgtcgccgtcgtcgtccaccatcgacctcgacgtcgccacgccgctcaagttcgacagcggttactacaccaacctgcag

SEQ ID NO: 7125 - DNA, 576 bp, Artificial
  Synthetic
cccacgcgtccgcccacgcgtccgcgacgttctacgcctcgtcgtgcccgaccgcgctgtcgacgatcaggagcgccgtgaacgcggcggtggccagggagccccgcatgggcgcctccctgctcaggctccacttccacgactgctttgtccaaggatgcgacgcgtcgatactgctggccgacaatgccaccttccggggggagcagggtgcgttccctaatgtcaactcgctgaggggattcgagactctgtcgtacttgccgccattgacagtggaggaccttttgaagcagatcgagtacctgctccgatctaagtgggtgccttgcttggagttcagcaaggtcggattcgtctaccgtgagaatcacagatcacccggatactatgacggtaggtactggaccatgtggaaactgcccatgtttggatgcaccgatgccacccaagtgctcaaggagctcgaggaggcaaagaaggcataccctgatgccttcgttcgtatcattggctttgacaacgttaggcaggtgcagttaatcagcttcatcgcgtataagccaccgggttgcg

SEQ ID NO: 7126 - DNA, 705 bp, Artificial
  Synthetic
gatccagttcaaaagtccaccaacccccccactgcagaagcatctttgaagttcttgatatatggtagaacagggtggattggaggtctccttggcaagatctgtgagaaacagggtatagcatatgagtacggaagcgggcgtctggaggaaaggtccacgctggtggctgatattcggaaggtcaagcctactcatgttttcaatgctgctggtgtgactggtcgacccaatgttgactggtgcgaggatcacagaactgagacaataaaaaccaatgttactggtaccttgaccttggcagatgtttgtagacagaatggattgctgatgatgaactttgctactggctgtatctttgaatatgatgctgaacacccagaaggatcaggtatcggattcaaggaggaagacacacccaatttcgctggttcattctactcaaagaccaaggccatggttgaagagctgttgaaggaatatgacaatgtttgcactctcagagtccgcatgcccatttcctcagaccttagcaacccacgtaacttcattacaaagatcagccgttacaacaaggttgttaatattccaaacagtatgacagtcttggatgaacttcttccaattgcagtagagatggccaagaggaatttgagaggtatttataactttacaaaccctggtgttgtgagtcataacgagatc

SEQ ID NO: 7127 - DNA, 1225 bp, Artificial
  Synthetic
tcgaccacgcgtcgttctcttcagattcactcttctctctctctttttctccatatattatgggtttcccagctaacagcgaaaagccattcaagttcttgatctatggccgcaccggctggattggtggcgtactcggcaagctctgtgaagctcaaggtatagactacgtatacgggtcgggtcggttagaaaaccggagctctttggaatccgacatatccaccatcaaaccgacccatgtattcaacgcagctggagtcactggccggcctaacgttgattggtgcgaatcccataaggtggagaccatcagaactaatgtggtcggcactctcacgcttgctgatgtttgtagagagaagggcttgatccttatcaactatgctactggatgtatatttgaatacgatgcgggtcatccgttagggtcgggtatcgggttcaaggaagaggatactcctaatttcactggatctttctattccaagactaaagctatggtggaggaattgctgaagaactatgacaacgtctgtactttacgagtcaggatgcccatctccgctgacttgacaaacccgcgaaacttcatcaccaagatcactcgatacgataaggttgtcgatatcccaaactcaatgacaatcttggatgaacttctcccaatatcactcgagatggcaaagagaaacttgactggcatatggaacttcacaaatcccggtgttgttagccataatgagattcttgaaatgtaccgggactatgtcgacccgagctttagttggaaaaatttcactcttgaggagcaagcaaaggtcattgttgctccaaggagtaacaatgagcttgatgcttccaaactgagcaaggaattccctgaaatgaagtcaatcaaagagtccctcattgagtatgttttcaagccaaataggaaaacaccagtggcttgaaacgttgagaaaaacttcattttattttttgttttgccttgttgaacgaatcaactatgtttcaagttctaatagctgggtttgccttgtcttttttcttgtcattttcttattttgagtttctttgggaagatgtgaactccctgtcataggaggtggaggtgcaactttttcctgtttcttttcttttccttttttgttgtattgaatgttgtaatggtatttatttcacgaataaattgaaaatgatatgccaattggatgatagg

SEQ ID NO: 7128 - DNA, 669 bp, Artificial
  Synthetic
ggaggcggcgccatggttgttcctctcagtagcaacgccaccaacggatccggcggcgccgccttgaaattcctgatctacggccgcacgggatggatcgggggtctcctgggggacctctgccgcgaccagggcatagatttcgcctacggatcggggcggctggaggatagggcgggattggaggcggacatcgcggcgatcaagccgtcgcatgtgatgaatgccgccggggtcaccgggcgccccaacgtggattggtgcgaggaccaccgggcggagacgatccggtccaatgtggtgggcacgatcaatctggcggatgtgtgccgcagccatggattgctgctcgtgaatttcgccacgggatgcatcttcgagtacgatcaggggcaccagatccacagcggccttggattcaccgaggaggattctccaaatttcgtgggatcgttctactccaagaccaaagccatggtggaagagctgctcaagaactatgaaaacgtctgtacgcttcgtgtgcgaatgccgatctccagcgacctctccaatccccgcaacttcatcaccaagatcactcgctacgagaaggtggtaaacatcccgaattcgatgactgttctggacgagctgctgccgatctcgatcgagatggccaagcgcaac

SEQ ID NO: 7129 - DNA, 694 bp, Artificial
  Synthetic
gaaaacccaaaacctcataaaacacaagagaattaaaattcaaaagcaaaatgaatcattctatttatacagagttgctgccggcgaattttccgggagactttccggtgtaccgccgaaattcaagcttcagtcgtctaattccatgcttaactgaaacatggggcgaattaccactaaaagtcgacgattctgaagatatggtaatttatactctcttaaaggacgctcttaacgtcggatggtcgccctttaattttaccgccggcgaagtaaaatcggagccaagggaggaggaaattgtggtttccccggcggagacaacagccgcgccggcgactgagataccgaggggaaggcattacagaggtgttagacgacggccgtgggggaaatttgcggcggagattagagatccggcgaagaatggagctagggtttggcttggaacatacgaaacagatgaagaagctgcaattgcttatgataaagcggcttatagaatgcgcggttcaaaggctcatttaaatttcccacatagaatcggtttaaatgaaccggaaccggttcgagtcacggcgaaaagacgagcatcgcctgaaccggctagttcgttggaaaatagttcacctaaacggagaagaaaagctgttgcagctgagaaatctgaagcagtagaagtggagagtgaatc

SEQ ID NO: 7130 - DNA, 822 bp, Artificial
  Synthetic
cccacgcgtccgcggacgcgtgggttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttcca

SEQ ID NO: 7131 - DNA, 457 bp, Artificial
  Synthetic
tggaaataagaagatgtttttaaatcttacggacgtgaagaaacaaaacatccctccccatttgttgcaacttgcaagcacactaaacctacacaattcgtttcctctgtacaattactttatacaccttaaggaaactgctcacactcttaatatgctaaaatgcctcacaggaagatcaagataaatcgctctgatttctttgaagctcttcatgcacatcacttatcttccttttccttcctgaattcactggagcttcatatttcccgccgtcaaaagggaagttgagcacggctttttttccccggagcttgaaagctgcacagtcataggctcttgcagcatcaacatcactctcaaatgttcctagcccagattcttgatcctttctttgctggatctcaaatctctgctgcaaatttcccccacggccttcgcctcactcctcggtaat

SEQ ID NO: 7132 - DNA, 829 bp, Artificial
  Synthetic
atacaatcaataaatttataacatcaacaaatacaaaattaaatttatattttcaacatccaaatattctactaaaaaaaataatgaataaaatgattggtactaattaaactacttatttgatatttgcacactaccgctacctttatattatacaagaataaatgaaatcatgagagtgacgcaagtgaaaacgtcatcgtacgttgacttttccgaagttttaagtgacggagataacggaaaagttgggagacgtcggagataacggaggaatactgaaaataccatctcctgctcccacatcccaaaaccccatccaacttgacggcgtcaatggtaccaccggctcaacctcagcctccgtcgtctccgacgtattactctcttcttcctccactttaaccctagccgccttctcctcttccggcggagaacccttatctcgctttcgtttccctaatccgataactccttccccagaacaagtttctgacgtaaccctaacatcgagagggaaattcaagattgcttttcttccacgtaattgaaacgccgcttggtcataagctcttccagcttccacggcagtgtcgtaagtcccaagccagatcctacaaccctttttgttcggatccctaatctccgccgcgtattttccccacggtcttcgtctcactcccctgtagtgcctctcttcttcctctttctctgtctttgttgaaaccgttctcgagacggatagattcggtaagggcggtttacgctggttaagagtcgaattcggccccaggggattggttggtgatggttctagcggacgcgtggg

SEQ ID NO: 7133 - DNA, 612 bp, Artificial
  Synthetic
aagaagggtgcaagagttgtagtagcaaatcgtacctacggaaaagcagtaagtcttgctgctgcagtgggtggtcatgccctgagattagccgagcttgaaactttcaggcctgaagaagggatgatccttgctaatgcgacatcattgggaatgtaccccaatgtggacggcacccctatcccaaagaaagcattaagcttctatgatgttgtatttgatgcggtatatgccccgaaagttacccggcttctacgagaagcagaagaatgtgggattaaagttgtcagcggtgtagagatgtttgtcagacaagccatgggtcagtttgagcatttcacaggtggtattgaagctcctgaaagcctgatgcgtgagatagctgccaaatacacataacaggcgaatggcgaagcgacggttgtgagtaattagcccaaatattcctctgggttaagttaataaaagttttggatgccagcccaattttgtgctaggtggagattagttgttgtaatgttcgatttcgccgacttaacctgtcagagatgtaaacagaaagtgttcaatctcatcatacttgcaataaagaatttgcatgcataactgcgt

SEQ ID NO: 7134 - DNA, 599 bp, Artificial
  Synthetic
ggggtttcggctccggggcaaccaacaattaaagatcttttgaatatatacaatttcagacagttgggaccagataccagagtatttggcattatcgggaagcctgttagccatagcaaatcacctttattgtataatgaagctttcagatcagttgggtttaatggtgtttatatgcctttgctggttgatgatgttgcaaatttctttcggacttactcatgtttagatattgctggcttcagctgtacaattcctcacaaggaagccattgtcgactgctgtgatgaaattgatcctaccgctaagttaataggggctgtcaattgtgtcgtaaggcgacctgatgggaaattgtttggttgcaatacagactatgtgggtgcaatctccgccattgaagaagcgttgcaaggctcacagcctagtatgtctaggtctcccttagctggtaaattatttgtggtcattggtgctggcggcgctggcaaggcacttgcttatggtgcaaaggaaaagggggctcgggtggtgattgctaaccgtacctatgaacgagcgagagaacttgctgatgtagttggagggcaggctttgtc

SEQ ID NO: 7135 - DNA, 588 bp, Artificial
  Synthetic
aaaaatgtgacttttggtcaaaatattgattcacatgcactgagttcttcccggatagatctgaagtgcaatgcctgcatcgatggcaaaaggttctcaatccggatcttgtcaaaagaccatggactcgggaggaggatgataagatcattgaactggtcgccaagtatgggcctatgaaatggtctgtcatagctaaatcattgcctggtcgatagggaagcaatgtcgagaggtggcacaatcatttgaatcccaatataaaaaaagatgcttggacactgaaggaggaacgagcactcatagatgctcatcggatccatggtaacaagtgggctgaaattgctaaggtcctgcccgggaggactgataatgcaatcaagaatcactggaatagctctttaaggaagaatagacttttatttagctactactggaaaccttccacctgctaccagggacagccaggaaaatggttttaaggacactactgaaacagctaaagctgaagagtcacttgtagcttcatcaggaactgcagatatgtgtaaaatagaaaatggatggcaggtcacagaaatcagtgct

SEQ ID NO: 7136 - DNA, 569 bp, Artificial
  Synthetic
gtaagtttctttctaggaaaatccgcaacaaacaaattatcccaagaaaataataacttagcaaaaagaatgtgcggtggtgccataatctccgactgcatacccccaacccgatcatcccgccgactcaccgccgacttgttatggggttgctccgatctgaaccaaaagaagaatccttttagttacgaatactcgaagccgttgagatctgaggttgctgatttaggtattgattttgaggctgactttcaggactttaaggactgctctgatgatgaggaggactcttacaaggtggacggactcaagccatttgctttttctgctcctgaacagtctggagcctctgttggctccaaatccttgaaatctgttgattcagacatggaagttgagaagtcttccaagagaaagaggaagaatcggtatagggggatcagacagcgtccttggggtaagtgggcagccgaaatacgtgatccacagaaaggggtccgagtctggcttggaactttcaatactgcagaagaagctgccagagcttatgatgttgaagctcggaggat

SEQ ID NO: 7137 - DNA, 385 bp, Artificial; identical to SEQ ID NO: 4613
  Synthetic

SEQ ID NO: 7138 - DNA, 63 bp, Artificial
  Synthetic
gcagcatgcccctctcgtcaccaaggccaatggccgtaaactcacggctgatgaactctggtc

SEQ ID NO: 7139 - DNA, 959 bp, Artificial
  Synthetic
cccacgcgtccgttttgaaatctcaacaagaaccaaaccaaacaacaaaaaaacattcttaataattctctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataaggggttgacggtgaagtgcgaggttgttgaagtggcacgtggcgatcatttattggttttataattttgatttttctttgttggattatatgattcttcaaaaaagaagaacgttaataaaaaaattcgtttattatt

SEQ ID NO: 7140 - DNA, 319 bp, Artificial; identical to SEQ ID NO: 1109
  Synthetic

SEQ ID NO: 7141 - DNA, 455 bp, Artificial
  Synthetic
gcagcatgaacaaaggagcttggactaaagaagaagatcagcttcttgttgattacatccgtaaacacggtgaaggttgctggcgatctctccctcgcgccgctggattacaaagatgtggtaagagttgtacattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgt

SEQ ID NO: 7142 - DNA, 566 bp, Artificial
  Synthetic
gcagcatggtgaggcctcttgttgtgacaaaggaggagtgaagaaagggccatggactcctgaagaagatatcattttagtcacttacatccaagaacatggtcctggtaattggagagctgttcctaccaatactgggctgcttagatgcagcaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtctt

SEQ ID NO: 7143 - DNA, 99 bp, Artificial
  Synthetic
gcagcatggggagacagccatgctgtgacaagctaggggtgaacaaagggccgtggacggtggaggaacatactaagcttatcaacttcatactaacca

SEQ ID NO: 7144 - DNA, 690 bp, Artificial
  Synthetic
aacccaaacacaacaagtccattttcaaaatttcccttaactatctttcttgttgtggttatttttgcaaaatggaattttttaacaggtgttcgacatctactacttcatcttcatgtgaatcatcttcatctgaatcttcactttctggtaaaacaccaagagatgggaaaaaatccgagagaataaagggaccgtggagtgctgaagaggacaagattttaactaaacttgttgagcgatatggggctagaaattggtctttaattagtaaatatataaagggtaggtctggtaaatcttgccggctccgatggtgtaatcaattaagtcccaatgtgcaacaccggccattttcgcaaactgaggatgacaccattttggctgctcatgcaaaatatggaaatcgttgggctactattgcaagattacttccgggtcgaaccgataatgctgttaagaatcactggaattcgacactaaaaagacgttaccaacagttacttcagcagcatcagcaaaatcagagttcagttgttttttctgatgtgaaaattaacgggtcagcatcgggatctgggccgtgcatggattatatgaatgctaatgacagtccaattagagggaattttcctattaataatgctgttacgactaattgtagcagtgaatttgatgacccaatgacga

SEQ ID NO: 7145 - DNA, 114 bp, Artificial
  Synthetic
gcagcaatgaactcatttcaggttttcctgaaatgtctggctccgatgacgatcctcaaggcggagatcatagtccgacgttgggcacgagttgtccgaagaaaccggcgggcc

SEQ ID NO: 7146 - DNA, 548 bp, Artificial; identical to SEQ ID NO: 1013
  Synthetic

SEQ ID NO: 7147 - DNA, 650 bp, Artificial
  Synthetic
gcagcatgatgtgtagtcgaggccattggagacctgcagaagacgagaagctaagagaactcgtcgaacaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgtctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagttcttgaccggaaagatcgggttcagaaatagtactactccaatacaagaaggagcaatagaccaaactaaacgaccgatggagttctacaattttcttcaagtaaacacggattcgaagatacacgaattgatagataattcaagaaaagac

SEQ ID NO: 7148 - DNA, 329 bp, Artificial
  Synthetic
gcagcatggctgataggatcaaaggtccatggagtcctgaagaagacgagcagcttcgtaggcttgttgtgaaatacggtccaagaaactggacagtgattagcaaatctattcccggtagatcggggaaatcgtgtcgtttacggtggtgcaaccagctttcgccgcaagttgatcatcggccgtatgcggctgaggaagacgacacgatcgcacgtgctcacgctcagttcggtaataaatgggcgacgattgctcgtcttctcaacggtcgtacggacaacgccgtgaagaatcactggaactcgacgctcaagaggaaatgcggc

SEQ ID NO: 7149 - DNA, 511 bp, Artificial
  Synthetic
cccacgcgtccggcatcagaatgggttacaatgactttggagatttctattacgcatgtggtatgctcggagatgctttcaagaactatatccgaacacgcgactactgcactacgacaaagcacatcattcacatgtgtatgaatgcgattcttgtcagcatcgaaatgggtcagtttactcatgttacaagctatgtgaacaaggcagagcagaatcctgaaacccttgaacctatggttaatgcaaaactgcgatgtgcatctggattggctcatttggagttgaagaagtacaagctagctgctcgtaagttcttagatgttaacccagaacttggaaattcctataatgaagtcattgctcctcaagatattgccacctatggtggactctgtgccctggcaagctttgatcgatcagaattgaagcaaaaagtcattgacaatatcaacttccggaatttcttggagctagtgcctgatgtgagggaacttatcaacgatttcta

SEQ ID NO: 7150 - DNA, 591 bp, Artificial
  Synthetic
aacagatctacacctacagatcggtgctctgctcgcagcttcagctagggaacagttccaatcacacatcgcgactggccacaccggatgtgctacacgcatcattcttcctcttcctcttcttaggtcgcttctcttcgctctgcccacttgctaaaccataccggcgataaacgtggagctccatggcggcctcggccgcgcagagcaacagtgccccgccgtcggatggaagcccagagtcgtcggaggcggcgaagaggctgaacacgcgcgcggccttgttcagggccaccggcttcgacgacaccacctcgcctctcaccgccctcatcgccgccgccgccgccgccgcagctcgagcactcgtcctccccaacgttgagaccaaccttatcaaagagagcatcagaatgggttacaatgacattggtgatttcttctatgctcatggccacctttcagatgccttcaaaagctacatccgtacacgtgattattgtaccacttccaagcatatagttcagatgtgtatgaatgtgattctggttagcattgagttgggacaatttccacatgtttccaactatg

SEQ ID NO: 7151 - DNA, 679 bp, Artificial
  Synthetic
ggatggaggggggcgatgcgagcggcagcgcgggcggtgatcagctggacctggaggcgtacgcggcgctctactcggggcggaccaaggtgacgcgcctcttcttcatagctgaccacgccaagtcccagacgctggagctggaggctctgcgcatggcgcacaacgagatacgcaagtcggacaacacgctgctgtacaaggaggcggtggacaagattggtggccgcctgggcgccgcctatgctctcgaccaggaatgggtggatgtcgtcgatcgcaggtccttgcagcgccaggagaagctcgacatggagctcaatggttacaagaccaacctgatcaaggagagcattcgcatgggctacaacgacctgggggatttttactacacccgcggtgacctgcagcaggcgttcaagtgctacgtccggactcgcgactactgcaccacctccaagcacataattgcgatgtgcctcaacgtcattctcgtcagcatcgagttgggccacttcgtgcacgtctccaactacgtgaccaaggctgaccagacgccggacatccaggatcctatcattttcgccaagctcaagtgtgctgcggggctggcgtacctggagaacaagaagtacaagcttgctgctcgtaagtttgtggataccaatttcgagcttgg

SEQ ID NO: 7152 - DNA, 557 bp, Artificial
  Synthetic
aagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaa

SEQ ID NO: 7153 - DNA, 724 bp, Artificial; identical to SEQ ID NO: 4604
  Synthetic

SEQ ID NO: 7154 - DNA, 619 bp, Artificial
  Synthetic
ggcacttccgaggcatccggcagcggccatgggggaagtgggcggcggagatccgcgacccgcacaagggcacgcgcgtctggctcggcacgttcaacaccccggaggaggccgcacgcgcctacgacgtcgaggcgcgccgcctccgcggcagcaaggccaaggtcaacttccccgccacgcccgccgccgcgcgcccacgccgcggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacat

SEQ ID NO: 7155 - DNA, 704 bp, Artificial
  Synthetic
caaaaagaaaaaaatttacaaaaacgaaactgatttctgcataaaacttttctgctgagagaaaacaaaaagcatgtgtggtggtgctataatctccgattacactgccccgagccggacttctcgccggctcaccgccgagttgctatggggccgatccgatctgagcaataagcaaaatttttttaacaattatcactccaagcggttgagatcccaagtagttgaccttgacgatgacttcgaggctgattttcaggacttcaaagatttctccaatgatgaggatgttcaagtcgatgtcaagcgatttgccctctctgcttcgaaaaactctactgttgaaggctccaaatctatgaaaacggttgattcagacaaggatgctgatagatcctctaagagaaagaggaagaatcagtatagggggatcagacagcgaccttggggtaagtgggcagctgaaatacgtgacccaagaaaaggagttcgggtctggttgggaactttcaatactgcagaagaagctgccagagcttatgatgtcgaggcaaggaggatcagaggtaataaagctaaggtaaactttcccgatgaagctccagtgcctgcctcaagacgtactgttaagctgaatcatcagaagggccttcctaaggagagcctggactctgttcagcccgactcaactatcatgaataaca

SEQ ID NO: 7156 - DNA, 444 bp, Artificial
  Synthetic
cccacgcgtccgcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggttcagtttttggtaagaaagttactggcttggatggggacgctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacatg

SEQ ID NO: 7157 - DNA, 534 bp, Artificial
  Synthetic
  misc_feature (482)..(482): The residue at this position can be any nucleotide.
ttcttggccatagccgtatatacgagctgagaaatcgtcaaaatgtgtggtggatcgatcatttcgaccttgtcgcttcctgataggggtaaggcctccctcgccaaacctcctcttcttaccttcccccctgatgatgacttggaatggctctgtggcctgcctgaatccgaatccatcaatgatgacggattcttccgcaaatttctcgattccaatagtgaactgcagcaggacatagctggcgtctttcctgatctgtgctctcccggtcttgacaattctgaagaggtcattcctgttcccactcccgctcccgctcccgtgaaaagtaggagtaggaagcacctgtaccgaggcatccggcagaggccttgggggaaatgggctgcagaaattcgtgaccccaaaaagggtgtcagggtctggcttggcacatttgaaacagccgaagaagctgcccgtgcctatgataccgcagnccgaaagatcaggggcagcaaggccaaggttaatttcacccaagaaatcccc

SEQ ID NO: 7158 - DNA, 651 bp, Artificial
  Synthetic
gaattcaacaagaaaacaatttcatttcaacttgctcttaaataataaaatccttcctcttaaattgcattctcaaaaaacaagaaaacaatttcatttctaatctttctcttctaaaagaaaaaaaaccctaaaaaactcacaaagatgtgtggaggagctataatttctgatttcataccaccaactaggatcagaaaactcactgctgatttcttatgggggcctaattcaaagacaaagaagaatgctgctggaagaaggaatttctatactaaaccttcttctttgattcaagatgatgttgattttgaagctgattttcgagagtttaaagatgaggatgatgaatctgatcaagagtatgatcaactcaaacagcaacaacaagttgtcaaatcttttgcatttaatgcttccaaatctgatgttcctgctcctaaagaaggatctaatgctgctgcaaaatctgcggaaaacaatggacctgctgacaaaaccgcaaagagaaaaaggaagaatcaataccgtgggattcgacagcgtccatggggaaaatgggcagctgaaattagagatccaaggaaaggtgttcgcgtctggcttggtactttcaatactgctgaagaagctgcacgtgcctatgatgct

SEQ ID NO: 7159 - DNA, 633 bp, Artificial
  Synthetic
aaaattacaaaatggccccaaggaatgaaactaccaatggatttagtggatcagtggccgcagtcacaccagtaaatccagtgagtatggcgacgccatctacagaaatgaagaagaagaggggaaggcctaagaaatatggaccagatggttctgtaaacactgcattgtcaccaatgccaatatcagcttcaatcccactttctggagatttttcaggttggaaaaacagtggaagtcgcccggttgagtccttccaaaagaagcagaagtttgagatttcaagtccaggggagagggtgccatactctgctgctgcaaatctttcaccacatgttggatactctggtggtgcaaactttacaccacatgtgatcactgttaatgctggcgaggatgttgcaatgaaaatcatttcatttgctcagcaagggtctagagctatttgtgtgctcgctgccaatggcgcaatttcaaatgttacacttggtcagccaaattcttctggtggaactttgacctatgagggtcgatttgaaattctctctctgacaggatcgtatatgtctagtgataatggagtaacaaaaaccagaactggtgggatgagtgtgtccctctcaggccctgatg

SEQ ID NO: 7160 - DNA, 242 bp, Artificial
  Synthetic
ttcctatcaaaatctgctggtttaggattcactccacacatcattactataccagctggagaggatgtttgcaacaaaaatcatggctttctcacaacaagggcctcgctcgatatgcatcctatctgccaacggagctatttcacatgtgacactacgccaatctgcaacttctggtggcacagttacttatgagggtcgttttgagattttgtccttgtcgggatcctttcttctaacag

SEQ ID NO: 7161 - DNA, 675 bp, Artificial
  Synthetic
acaaaatacacaacaaaaccctcggtttagtttggattacacgtgagggtgggccgtcgtcacctagggattcttcgcgggcaaggaagaaacgagggcggcccagaaagtactctcctagtcctgatggtaacaacatagctttgggcctctctcctactccactacttactcccatttctgattctgctgctgctggtgggcccgccactcccacttctgaaaactcctctaagaagctcagaggcagacctcctacccctttaaagaaacagctcgatgcactgggtacaggtggagttggctttacaccacatgtaatcttggtgaacgttggggaggacatagcatcgaagctactggctttctcagagcaaggaccacgtacagtttgcatactatctgcacatggagccatttgtaatgtcatcctacggcaaccagccacggggggtagcactgtaacttgtgagggccgatttgaaatcatctctttatcaggttcgttcttgcgctctgaaagtaacagtggcaaaacaagtagtctaagcgtgtcactggccgggtcagacggtagagttttgggcggtggagttgcaggactgctcacggctgcaacaccagtacaggtgattgtgggtagcttcattgcggaagggaagaagccgaagtcta

SEQ ID NO: 7162 - DNA, 624 bp, Artificial
  Synthetic
ccgatttgatcctgtgttgctgttgaaagaaaacccggagtggttgtacggcatcccgctgtggttgatcgggctgcccgagtcatcggacgatccactggatgtgccctccgatggcgggctcgccaccggagctggcacgtaggttgccatctgtggaggcgctgaaatcggttcgaccttccttgtctcgactggcttcgatttcttaccttccgcgatgaagctagccacgacaacctggacaggggttgcggccatcagcattccagctacacatccaccaagaactcggccatcagatcctgcaagtgcgacactcaggccaccagtcctgctgcgagtgtcgccatcctctgcaagcaggaaagaacctgatagagagatgatctcaaatcggccctcataagtcacaagtccaccagatgtagctggctgccgaagtgttacattgcttattgcaccattcgctgagagaatgcaaactgtgcgagggccttgctgtgagaaggccataatttttgaagcaacatcctcgccggccttgacggtgaggatgtgaggagtgaaggcgatgccccatgagcctagggcttcgaactgcttcttcttgccggagccggg

SEQ ID NO: 7163 - DNA, 523 bp, Artificial
  Synthetic
ggggagcaagtgatatatataaaaggctggaagatcagaagtgtactacaagcaggaatcttgatcccttggtacctgcttgtatctacattgcatgtcgtcaagaaggcaaaccccgcactgtaaaaaaaatatgctcaattgccaatggagctactaagaaggaaattggccgagcaaaagaattcattgtgaaacaattgaaggttgaaatgggagaatcaatggagatgggaactatacatgctggcgactatctgagacgtttttgttctaaccttggtatgaaccatgaagaaattaacgttgtccaagaaactgttcagaactcggaagagattgacataaggaggagtcctatatcaattgctgcagcaataatatacatgataactcaacttacagatatgaggaaacccctgcgagatatctcaattgcaaccacagtcgcacaagggactatcaacaatgcgtacagggatctttatcctcatgcttccaaaataataccacaatggtatgt

SEQ ID NO: 7164 - DNA, 701 bp, Artificial
  Synthetic
ttctgagctgagctgagctagcatccatggccaccacagccctctcctcagccaacttggccatctcaaaggccaaatccagctacactgctgctgagaccaccaagctgcatagccatggcctttctagtagcgcctcgctcgcctccaagcggattccgtcggttgggtccagtgctcgccggccttcccgcgtcgctgccatcagaatggattccaccaaagataagccccgtgctggtgctaaggaggctgctaaggagtccctcctcaccccccgcttctacaccactgacttcgaggacatggagcgcatgttcaacatcgagatcaacgggaagctcaacgaggaggagttcgaggctctccttgcggagttcaaggctgactacaatcagacccacttcgtccggaacaatgagttcaaggaggccgccgccgctatccaggggcccatgcgccagatctttgtcgagttccttgagaggtcctgcaccgctgagttctccgggttcctcctctacaaggaactgggacggagattgaagaaaaccaatcccattgttgcggaaattttcaccctgatgtcccgagatgaggctcgacatgccggtttcctgaacaaggggctctcagatttcaacttggctcttgatctgggcttcctcacaaaagcaaggaagtacaccttcttcaagcct

SEQ ID NO: 7165 - DNA, 720 bp, Artificial
  Synthetic
aaacctcgcgaagaacaagcagctacattctctcgagcgcgattcgcggcgtcaacaggggggcatggcggcggcaatgtcggcagccagcgtcggcaatgtgaaggtgagtggatttggcggccgatggcgagggttccagtcgaaccgcggcggcagcgtggtgttctccaggaagatcgtggccagcgccgccgccgccacgaaagacgcccccaggaagggcgccaaggaggcggtgaaggacacgctgctgacgccgcggttctacacgacggacttcgacgagatggagcagctcttcaatgcggagatcaacaagaagctcaacatggcggaatttgaggcgctgctcgcggaattcaaggccgactacaaccagacacacttcgtaaggaatccagagtttaaggccgcggccgacaagatcactggaccgatgaggaagatcttcgtggagtttctggagaggtcgtgcactgccgagttctccgggttcttactctacaaggagctgggaagaaggctcaagaaaaccaatcccgtggttgcggagatttttacgttgatgtctcgagacgaagcacggcatgcagggttcctgaataaaggtctatccgactttaacttggcgctggatcttggtttcctgaccaaggccaggaagtataccttcttcaagccgcagttcatcttctacgcgacttacctctcggagaa

SEQ ID NO: 7166 - DNA, 173 bp, Artificial
  Synthetic
gagcatggataaggagaactctccatcacctccttgtggaggtgttcctcctccatctgcatgaggtcgatgctctgctttctcataacctggtcccataggtcatggttcagatgctactcgaatgagtcatgatattagccgtatgcttgagaacccacctaagaatattg

SEQ ID NO: 7167 - DNA, 719 bp, Artificial
  Synthetic
tttctctctcttttatcttcctttatagctttactcctatcttcgtctctcctgcatttaactaaatttaagggagagatggtgagaggaaaaacagagatgaggcgtatagagaacgcaacaagcaggcaagtcactttctctaaacgcagaaatggtttgctaaagaaagcatttgaactttcagtactttgtgatgctgaggttggtttggttatattttctccaagaggaaagctctatgaatttgccacttctagcatgcaggagataatagagcgctataagagacattctaaagacaaggttcaacctgaaaaccaagcagtgggacacgatatgcagcatttgaagcatgagacagcaagtttgatgaagaagatagaacttcttgaaacatctaaaaggaaactcttgggagaatgtttagggtcctgtaccctagaagaattacagcaaatagaaaaacagttggagcgcagtgttagcgcgatccggtcgcgaaagatgcaagtctttagggaacaaatgcaaagattgaaagaaaaggagaaagcccttgcagttgaaaatgcaatgctgagggagaagtttggaggtcttcaacagagacaaacatcaagcggagagaaggaaggagaagttatttgtatagagggaggtagcgataaatcggatgtggagacagaattgtttattggaccacctgatgaatgtag

SEQ ID NO: 7168 - DNA, 285 bp, Artificial
  Synthetic
ttcttctctccctctttcatttcatttaatttggtaccctttttaatctttgcactactaaaagtagtaccagctgctaaccaagagtggaataatcccttatatcatctctctggcaaaatacaaagatagaaagaaagagaaaagagaataaaaatgggaagaggaagagtagaactgaagagaatagagaacaaaataaacaggcaagttacttttgctaagagaagaaatggacttcttaagaaagcctatgaactttctgttctctgcgatgctgaggtt

SEQ ID NO: 7169 - DNA, 613 bp, Artificial
  Synthetic
gcagcatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggtaaaagaaatcgagctgcaaaacgataacatgtatctccgctccaagatttctgaaagaacaggtctacagcaacaagaatcgagtgtgataca

SEQ ID NO: 7170 - DNA, 678 bp, Artificial
  Synthetic
gcagcatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaac

SEQ ID NO: 7171 - DNA, 367 bp, Artificial; identical to SEQ ID NO: 1141
  Synthetic

SEQ ID NO: 7172 - DNA, 378 bp, Artificial
  Synthetic
caaagctatacaaaatatatagaattttctgcaagctttagaaaggaagatggagtttcctaatgaagaatttgagtcatctaattctcagagaaaatcaggaagaggaaagattgaaatcaagaggattgaaaatactacaaatcgacaagttactttttgtaagcgtagaaatggactccttaaaaaagcctatgagccttctgtactttgtgatgctgaagttgcccttattgtcttctccagccgtggtcgcctctatgaatatgccaacaacagtgtaagggcgaccattgataggtacaagaaacaccatgctgattccaccagtcaaggctctgtttctgaagctaacactcagtactaccagcaagaagc

SEQ ID NO: 7173 - DNA, 257 bp, Artificial
  Synthetic
ttttctctacccgtggcaagctttatgagttctctagcacatccaacacgctcaaaacccttgaaaggtaccataaatgcaactccgggacgtgagaagctaaacactctggcagagattctaatgatgaaaagttctatacggagtacttaaagcttaaagccgaatatgagtccctgcagcgatatcaaagacaccttcttggggatgaactgggccctctaaacatagatgagctcgagcaccttgaacttcag

SEQ ID NO: 7174 - DNA, 630 bp, Artificial
  Synthetic
acgcgtgggtttgagcaaaaagaaaaaaaaacaatggctcgtgggaagatccagatcaagagaatagagaaccaaacaaacagacaagtcacttattctaagagaagaaatggacttttcaagaaggcaaatgaactcactgttctttgtgatgctaaagtttctataattatgatttcaagtacaggaaaacttcatgaatttataagtccttctgtcacgaccaagcagttgtttgatctgtatcaaaagactgttggagttgatctttggaactcccactatgagaaaatgcaagagcagttgaggaagctaaaggatgttaataggaatctccgaagagagatcaggcagaggatgggagaaagcctaaacgatctgaactatgagcagttggaagagctcaatgaaaatgtggacaattctctgaagcttattcgtgaaagaaagtataaagtgattagcaatcagattgaaacgtacaagaagaaggtccggaatgtggaagaaatacatagaaatctcttgcttgaatttgatgcaagacaagaggaaccatatggattggttgagcaagaaggggactataactctgtgcttggattcccaaatggagggccacgcatatta

SEQ ID NO: 7175 - DNA, 610 bp, Artificial
  Synthetic
aggtcgtaagagagcacgcacgtacttagcaaaatatagatcaggaattacattacattacattacatatgccctgtaattactggattacaggacactgtttgcattggcttctctgaagcctgaagcctgaactgaacacacacatcatatccagccggatgggatgtgttcattggggtgatgagcaaccatgtctgctgcttcattgctcagatggtccatgtaggcctggtgatggtgagcatgagggtgatgatacccaatctgcagggaatggtcaccctgatctgggtgagggtggagaagaccctgatggtgatgaggctgatcagcaagaacagtgctagaaccgctgtgcccaccaccatcttgccaggacatatggagcacattctctgcactggtttcctgtaactttttcctcaagtctttgttgagatcttgcagctgttgctccttgctcttcagatcaaacagctgatcaagcagtgcttggttctttcttgacctgatttgtttgagggatacttctatctggttctcaagctgctccagctccttcatgcttagtgggcccaaatcctcaccaagaatatttctctgtgtg

SEQ ID NO: 7176 - DNA, 537 bp, Artificial; identical to SEQ ID NO: 1128
  Synthetic

SEQ ID NO: 7177 - DNA, 349 bp, Artificial
  Synthetic
catatatatatagaattgcttgcaaggaaagagagagagagagattgagatatcttttgggagaggagaaagaaaaagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcag

SEQ ID NO: 7178 - DNA, 372 bp, Artificial
  Synthetic
tccggaaaaagtgcaagatggataaagaatttaaaacaagaatgaagagaggattttggaaacctgaagaggacttgatattgaaaaattgtgtggagactcatggagagggaaactgggccaccatttctgagaagtcaggcttaatgaggagtggtaagagctgcagactaaggtggaaaaattacctgaggccaaacatcaagcgaggaatgatgtcagaagatgaaaaggacctcatcatcagactccataagcttcttggcaaccggtcactgctttctcctctgcacctgatttcctgttatacaataagaatggtgaattgattcttctagctgtgcttacctacctcaaatcttctttggaaca

SEQ ID NO: 7179 - DNA, 529 bp, Artificial
  Synthetic
tttatactcttctcttctatagacatatgagcaaaaacatagtaattatgagtaataattcctcaaatgaagatgatcaatttgagctaagaagagggccatggactcttgaggaagataaccttcttattcattatatttctaccaatggtgaaggtcgttggaatgctctagctaaatgtgctggattgaagagaacaggaaaaagttgtagactgaggtggctgaattacttaaaacctgatattaaacgcggaaatctgaccccacaagaacaacttttaatccttgaacttcactccaaatggggaaacaggcggtcaaaaattgcacaacatttaccaggaagaacagataatgaaatcaagaattattggagaacaagggtgcaaaaacaagcaagacaactgaaggttgattgtcatagcaaaaaatttgttgaaccaatcaagagtctttgggtgccaagattacttgaaaaaatggagcaatcttcctccattgaaaaacataatccttcactacttac

SEQ ID NO: 7180 - DNA, 62 bp, Artificial
  Synthetic
gcaggatgggaagaacaccttgttgtgacaagattggtttgaagaaaggtccttggacgcct

SEQ ID NO: 7181 - DNA, 686 bp, Artificial; identical to SEQ ID NO: 1126
  Synthetic

SEQ ID NO: 7182 - DNA, 576 bp, Artificial
  Synthetic
ccccggaaacagcagcggctccagctcgccgtggtcgactttcccggcggcgatcaccggcagcggaggaggagcagtacgtgtgtatatataaaggatggggaggcagccgtgctgcgacaagctgggggtgaaaagggggccgtggacggcggaggaggacaagaagctgatgagcttcatcctgaccaacggccattgctgctggcgcgccgtgccgaagctcgccgggctgctccgctgcggcaagagctgccgcctccggtggacaaactacctccgccccgacctcaagcgcggcctcctcaccgacgccgaggagcagctcgtcatcgacctccacgccaagctcggcaacagatggtccaagattgctgccaagctaccgggcaggacggacaacgagatcaagaaccactggaacacgcacatcaagaagaagctcatcaagatgggcatcgacccggtgacgcacgagcccctcgaccggaagcaggagagcccggccaccacctcgcagtccaccgtcacggcggagtcgtccaagtccggcgaggcgaccaggcagcaaagccg

SEQ ID NO: 7183 - DNA, 624 bp, Artificial
  Synthetic
accactcgcgaactagacagaaaccgcaagaaaccaaacaccttttggctcctccactagtagcaactactcgttgtcgtcgtcgtcgtcgactcgtcgtggtagtagtagtcttcttcgcgtgacgccatgggaggaggaggaggagttgaggcggattgcgacaggatcagggggccgtggagccccgaggaggacgaggcgctgcggcggctggtggagcggcacggcgcgaggaactggacggcgatcgggcgggagatccccgggaggtcggggaagtcgtgccggctgcggtggtgcaaccagctctcgccgcaggtggagcggcggccgttcaccgccgaggaggacgccaccatcctccgcgcacacgcgcggctcgggaacaggtgggccgccatcgcgcgcctcctccagggccgcaccgacaacgccgtgaagaaccactggaactgctccctcaagcgcaagctcgccgtcgccaccaccaccaccaccaccaccaccggcgccgccgccgcgccgggagtggtcgccgatgccgccgagctcgtcgagcggccgtgcaagcggttcagccccacgccggacagcccgtcggggtctggttccgggtcggac

SEQ ID NO: 7184 - DNA, 762 bp, Artificial
  Synthetic
gtcgcctgcacggcaccgacgagagagcgcgcgcgcgtgttcgtccgagcttttctgcggtcgcgcggtgcaggaggcggggcgacggccggcgccgcagttcgcgggcgtggacctccgccggccgaaggggtacccggcggcggggcagctgacgccggcggcggaggaggcggtagccggggtgggcgacccgtgcccgcggtgcgagtcgcgggacaccaagttctgctactacaacaactacaacacgtcgcagccgcggcacttctgcaagtcgtgccgccgctactggaccaagggcggctccctccgcaacgtccccgtcggcggcggctcccgcaagagctcgacttcctcctcctccgccgccgccgccgccgcctcatcgtcgtcgtcgccttcttcgccagccaagagccccaagcgctccaagaactccaagcgccgccgcgtctctccgccccctcagcccgtgcctgcgccgccgccgcccaccaccgccgacgctgccgacgtagccgcaccgacggcaccagaagccacaaccaagaaagccccggaagacctcaccgcggcggcagcgacacagccggcggtggcgctcgggctcggcgtcgccgacggcggcggcggcgggaaggagcacctggacacgagcccgttcgagtggccgtcgggctgcgacctcgggccgtactggccaaccggcgtgttcgccgacaccgatccatcactgttccttaacctgccatgacaagc

SEQ ID NO: 7185 - DNA, 679 bp, Artificial
  Synthetic
gcagcatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgc

SEQ ID NO: 7186 - DNA, 752 bp, Artificial
  Synthetic
gcagcatggagagagcagaggccttgacatcatcgtttatatggcgggcaaacgcaaacgcaaacgcggagatcacgccgagttgtccaagatgtggatcctctaacacaaagttctgttactacaacaactatagcctcactcagcctcgctacttctgcaaaggctgccgcagatattggaccaaaggtggttccctccgcaatgttcctgtaggcggtggctgtcgaaaatcccgccgccccaaatcatcttctggtaacaatactaaaactagcctaaccgctaattctggcaaccccggtggtggttcaccaagcatcgatcttgctcttgtttacgccaatttcttgaatccaaagcctgacgaatctatactacaagaaaattgcgacttagccactacggattttttggtagataatcctaccggcacttccatggacccttcatggagtatggacatcaatgatggtcatcatgatcattatattaatccggtggaacacattgtggaggaatgtggttataatggcttgcctccatttcctggtgaagagcttctctctttagacactaatggtgtttggtctgatgctttgttgattggtcataaccatgtagacgttggcgtgactccggttcaggctgtacacgaaccggtggttcatttcgctgacgaatccaatgattccaccaatctcttgtttggaagttggagcccttttgatttcactgccgatggatgataa

SEQ ID NO: 7187 - DNA, 645 bp, Artificial
  Synthetic
gcagcatggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggg

SEQ ID NO: 7188 - DNA, 694 bp, Artificial
  Synthetic
gcagcatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagca

SEQ ID NO: 7189 - DNA, 622 bp, Artificial
  Synthetic
gaattcgaaagagcttctttttatagcaaaactgattctttttttctctctttctagaaaacagtcctgttggtgggttatagtttgtgttggatgaatcttcaacaccactacaactgaaagttaatccaaataccccaacaacaacttagaagaaaacagaagatcaggaaaataagaataatggcaagagagaagattcagatcaagaagatagataacacaacagctcgacaggtgaccttctcaaagagaagaagagggctttttaagaaagctgaagagctttctgttctttgtgatgctgaggttgcgctcatcatcttctcagccactggcaaactctttgaatactccagctcaagcatgaaggatatacttgaaaggcacaatctacattctaagaatcttcaaaaaatggctcagccgtccctcgaactgcagctagaaaacagcagctatgcgaggttgagcaaggaagttgtagagaagagccatcaattgaggcagatgagaggagaagaactccgtggtttgaacattgaagatttacaacagctagagaaatcacttgaagcaggattgagccgagttcttgaaacaaagggtgaacgaataatga

SEQ ID NO: 7190 - DNA, 650 bp, Artificial
  Synthetic
attatcttccctcaaggtcatatcgagcaggttgaagcatcaactaatcaagtggctgatcagcagatgcctttgtataatcttccttctaagatcctatgccgcgtggttaaccttctgttgaaggctgaaccagacactgatgaggtgtttgtataagtgactttgatgccggagccaaatcaagatgagaatactgtgaagaaggaatctatgcgccctcctccaccacgatttcatgtacactctttttgtaagacactaacagcatctgatacaagtactcatggcggattttccgtcttgagacggcatgctgatgaatgcctccccccactggatatgtctcgacagcctccgacacaggagttggtggccaaggatttacatggaaatgaatggcgctttaggcatatattccgcggccaaccaaggaggcatcttcttcagagtggttggagtgtcttcgttagttcaaaaaggcttgttgctggagatgcattcatatttcttagaggtgagaatggggagcttcgtgttggagttagacgtgccatgagacagcagggaaatgctccatcatcggtgatatcgagtcatagcatgcatctcggtgtacttgcgacagcttggcatgccattcaaacaaa

SEQ ID NO: 7191 - DNA, 638 bp, Artificial
  Synthetic
caaaaaggagtactgtcggcttcagctaggcaaagaccatcaccaattttctctctccagttctctctcttcctccatccatagctttactctctgtgaagacgagaaaaccctaattaaagctgtgtactagttcaactaatcgatcaatttgtagctcaaccttagttctgtgatcgagtgctaatattttaaagcttttttgattgtgttgtacatggaaatgaacgtattatccgtggtatatgatgactaatagagaaatccggctgaatacttgagataatcacttaaagggttggtgacttcaaattgattttcttatggcacatcttgcggcaaatcacttcggtggcggggctgctccagtggctccaaatgatgcattatacaaggaactctggcatgcctgtgctggacctcttgtaacagttcctcgtgaaggggaaagagtttattatttcccacagggtcacatggaacagcttgaagcatcgacacatcagggtttagaccaacaacttccttctttcaatttgccagctaaaatattatgcaaagtgatgaatattcaacttcgggctgagtcagagactgatgaggtgtatgcacagataactctgcttcctgaactcgat

SEQ ID NO: 7192 - DNA, 610 bp, Artificial
  Synthetic
gcttccgattaaccagagggaggataataacgacattgctgtgaatatgaatggtgacgtggaggatgcagaaaaggaagtcgtttctttcgttaagattttaacaccttcggatgcgaacaatgggggaggtttttctgtcccacggttctgcgctgattcgatattccctaggctcaatttcgtggctgaaccgccggttcagaatttgtttattcgcgatattcatggttgtgtatgggagtttcggcacatttatcgtggcacgcctcgccggcatttgctaactaccggctggagcaagttcgtcaacagtaaaaagctcgtcgccggtgattccgcggtcttcgcacggaaaactaacaccggagaactttacgtcggagtccgacgagccacacgaggaaacgacatttgcgagaggtggaattctactgttttgagaagtactgaacaaaccagtagcggtggggaagttcgttggaggactgggcaggggcgtgtggcgaccgaggcgattgtggaggcagcagaaatggcagcacggggaatggcgtttgaggtgtcgtgttatcctcgggcaggctgggcagattttgtggtgagggca

SEQ ID NO: 7193 - DNA, 573 bp, Artificial
  Synthetic
ggcacacggtggggttcgcacactgcaacacatttgcgggccggatccgtgggtcatcggtggatccaacgatgagcccaagatacgcggcccagctacagagatcgtgcccgcccaacgtggacccacggatcgccgtgaccatggacccggtgacgccgcgggccttcgacaaccagtacttcaagaacctgcagaacgggatgggccttctgggctctgaccaggtgctgtactcggacccacggtccaggcccatcgtggattcttgggcccagagcagcgccgccttcaaccaggcctttgtcacggctatgaccaagttgggccgggtcggggtcaagaccgggtcgcaaggcaacattcgtcgcaattgtgcagtgctcaattaattattaactgatgatcatctacatggttgttcttacactgagcttaattaatcttgtttttaaattattgctttcttttgcacaaatgtaaaggaaaaatgtaagaaaaattcaagccatatatagatgcatgtaaagtacaattaaaatggttggttatgaagttgtttgtggccgtgag

SEQ ID NO: 7194 - DNA, 641 bp, Artificial
  Synthetic
cgacctcgaccagctcaacaagctcttcgccaccaacggcctcacccagaccgacatgatcgccctctcaggagggcacacgataggggtgacgcactgcgacaagttcgtgcggcggctgtaccagttcaagggggcggcgccgcagtacagcccgccgatgaacctggcgttcctgcggcagatgaggcagacgtgcccgctcagctacagcccgaccaccgtcgccatgctcgacgccgtctcgcccaacaagttcgacaatggctacttccagacgctgcagcagctcaagggcctcctcgcctccgaccaggtgctcttcgccgaccgccgctcgcgcgccaccgtcaactacttcgccgccaaccagaccgccttcttcgacgccttcgtcgccgccatcaccaagctcggccgcgtcggcgtcaagacggccgccggctccgacgccgagatccggcgagtctgcaccaaggtcaactaataacgtagagcagtatagctcacatttgggtggtagagagggtaaattggtgaattcttctctgtgtctctcttcttcttcttcctcttcttctccatgatgatcttcgattctcactgtccatgttcacaagtccaccgcgcacagttgttgt

SEQ ID NO: 7195 - DNA, 401 bp, Artificial
  Synthetic
tacccacgcgtccgagcgttcaaagccaattgcctcagcccgagtttaacctaaaccagctcaacggcatgtttagccgtcacggcctctctcaaaccgatatgattgccctctcaggagcacacactataggatttgcacattgtggaaaaatgtcaaagagaatatacaattttagccctacaacacgtatcgacccgagtataaaccgtggatacgtggttcagcttaagcaaatgtgcccgatcggtgtcgacgtaagaatcgcaatcaacatggatccgaccagtccacgtactttcgataatgcttatttcaagaatctccaacaaggaaagggtttgttcacgtcagatcaaatcttgttcacagatcaacggtcaagatctacagttaattcg

SEQ ID NO: 7196 - DNA, 1222 bp, Artificial
  Synthetic
attaaacaagtttaatagaaataagattattaatattacagtcacgagaaataaaacaacggtttagattcgttaatgtgtttttcaaaaatacaagaagcagaaacaaacagaagacaacaaaacaaaaactcataacatgtcaaagaacaaatctcgaaaacaaaacccaaaaaggatgatcagttaaaggcaccacagtcacgacgaatgttaccgttgcgtctagtcttaacgccaacgcggccgagtttggtcatagcggttacgaaagccttgttgaaagcaacagaattcttggcccaatcgttaacggtgggctttgagcgaccatcggtgaagagaacttggtcggaagtgaagagtcctttgccttgttgcagattcttgaagtaaatgttgtcgaattgtcttggagtggttgggtccatgttgatggcgattcttgggtcaactgtcttgggacaagccaactgaagttctttagcgtaggctttgtttagagttgggtcaacggcgtgtgtgaggttgaagttgtagattctgttgaacactttgccacaatgggcgaatccaagtgtgtgagccgctgaaagagcgatcatgtcctcttgggtaagtttgtttttggcaaaaagcttgttaagttctgtaactttgttatttggtccgggcaagtttccgttaacgctagccgcagtcgacaccaaaccatcaaaccttccgagttccactgcgtacgacggacctttggcggcgacaacaacatcacgggtggctaaagcaagaatatcagcacaagagactttgtttttgcaacttgggatagcgtcaagagctttcttggctttgatcacaacgtcaaatccatctccggccaaagaaatattgtctggatgatccttctcggctttgttggtaggcgttgattgaatcatgaccgacgcatcacatccattgacgaagcaatcgtggaagaagaggcggagagtagctgggatggtgacgaaggtctgtttgattttttcttggacgacttttttcacgatttgttcaacattcggacatgagtttccgtagaaattggttttgagttgagcagtggttgtgtcagggaacatagagatggcaagactaagagtcacgactacaaccagactgaaccgcgccatttcgttggaaattacaagtttttgtgtttacaggaatgcggacgcgtggg

SEQ ID NO: 7197 - DNA, 668 bp, Artificial
  Synthetic
tgtcaacgaaataaacccatcttattaatttaagtttccatgtttcacacttatgaactccttattttgacaacaagaaattaaattttattattaaaaaaaaaaatcctctttaaggaataaaagaaagaaaacctcaaatcacactaattgacacgtgaacaatcccttcgaatctcaccagcattaccagtcaaaacaccaacccgacctaacttcgtgatcgctgtgatgaaagcttgtctaaaagctccttcactattggcaaacgaattaactgtagatcttgaccgttgatctgtgaacaagatttgatctgacgtgaacaaaccctttccttgttggagattcttgaaataagcattatcgaaagtacgtggactggtcggatccatgttgattgcgattcttacgtcgacaccgatcgggcacatttgcttaagctgaaccacgtatccacggtttatactcgggtcgatacgtgttgtagggctaaaattgtatattctctttgacatttttccacaatgtgcaaatcctatagtgtgtgctcctgagagggcaatcatatcggtttgagagaggccgtgacggctaaacatgccgttgagctggtttaggttaaactcgggctgaggcaattggctttgaacgctcggacgcgtggg

SEQ ID NO: 7198 - DNA, 440 bp, Artificial
  Synthetic
tcgacccacgcgtccgtggatcccacggttaacaaagattatttgacagagctaatttcgtcgtgtcctcgaaacatagatccaagaggggctattaacatggacccaacaacaccaagacaattcgacaacgtttactacaaaaacttgctacaagggaaaggattgttcacgtcggatcaagtcttattcacggatcgtcggtcaaagccaaccgttgacttatgggctaataatggacagttgtttaatcaagcttttattaactcgatgatcaagcttggtcgtgttggtgttaaaactggtagtaatggcaatatccgccgtgattgtggagcttttaattgatttaaatatatctgtattagattttgtttattgtatttgggtataggatgggtcatgggtctcataaagctggttcagctaaattgaaaatt

SEQ ID NO: 7199 - DNA, 642 bp, Artificial
  Synthetic
tttttaactagctagattcattctacgagttgatgacgtacacttcttcctgatctctccttcctccccggtgagcacctggacgttgcccatcttggtcatggactcgccgaagtcgctgaagaactcggcgtcgaacttgccggtggcgatccgccgcacgtagtccctggtggtggcgtcggtgagcagcgacgcgtcggaggagaagagccccctccgcttcgcgacatggcggtagtagctggtgtcgaacgtcttgtagctgcccgggtccatctcggagatcatgccggactcgtcggtggcgctcgcgcacctggccctcagcctgccggcgtactcgccgtccaccgacgggtcggcgtcgttcttgccggtgaagttgtagagcctgccggcgtaggacgggcagtgcgccgtgccgagggtgtgcgcgccggagagcacggcgaggtccttgatgtcgaggtcgttggcggcgaagatcctgaggagcgtcgcgatgtcgccgtcggcgggtggcaggctggcggcggcctcgccggcggcggacaccctgccgtccctcctccccagggcgaccggccaggtggggccccgcgccagcacgacggcgtcgcgcgccatgagcgtgagcac

SEQ ID NO: 7200 - DNA, 535 bp, Artificial
  Synthetic
aggtctccggcagttggttcgaacctggcccctcttcccagtgagcggcgcgatgccgcccatcttgatcatcgaccgcacaaagctctggaagaaggcatcttgatcgtagctgtagtagcgcacatagttctcggtgatgccgcggccactaaagagcacttgatccgacccgaagatccccttgccatactggagattgaggtagtagttgttgtcgaatctcaggggtgtgaccaggtccagcggcgccaccgtgttgccgttgccctgccgggggcagatctcgcggagagagcccaagaactgggacgtgatcgtggggtccggggcgccgctgccgcgatcattgaacaatcgctggcggaatgtggagcatcgggcgaggccgatgctgtgtgcgcctggaaggtgagattagggtaaattagctcaagaacactggacattccggctcggaatgtgtgggctgatggacggacgggatgtgatggattattacgtaccggaaagtgttaccatgtccacctcggtg

SEQ ID NO: 7201 - DNA, 590 bp, Artificial
  Synthetic
gcgaattgaagccatatgtaaaatcacagcccatccctgaaaccaatgacgaacctgttaaggtggttgttagagataccctccaggatatggttttcaactcaggaaaaaacgtactgttagagttctacgcaccttggtgtggccactgcaagaagctagctccaattttggatgaagtggccgtatcgtttgacagtgatccagatgttctgattgcaaaactggatgcaaccctgaatgatctcccaaaagatcaattcgacgttcagggattccctaccatgtacttcagatctgcctccggtaaattgtcacagtatgatggtgatagaacaaaagaggcaatcatcgaatttattgaaaagaatcgcgacaagcctgttcagtcagactctgccagaaccgattcagcaaaggatgaactatagaggtctttgggacacagtgcactggtggtggatgtaagatttgttggggatatgctgttttgatttccctacaatgtcgcaccgactgcctttctcgactgctctccccatgtactttaagcctcatctgtttcctgttttagttttttggttcttttt

SEQ ID NO: 7202 - DNA, 749 bp, Artificial
  Synthetic
cccacgcgtccgctcaatctagctctcttctctatctttctctaaatcatgggtcttcctgaagatttcatcaccgagcttcagattccaggttacatattaaagatactttacgtcatcggtttctttagagacatggtcgatgctctttgtccttacatcggtctaccaagttttcttgaccacaacgagacctctcgacccgacccgacccgactcgctctctccacgtcagcaactcttgccaacgagttaatcccggtggttcgtttctccgatctcttgaccgatccggaagattgctgcacggtttgcttatccgattttgtatccgacgataagattagacagctaccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggttttacttttactttttacttttttcacggtaatatttttctactgtataattctttcttccaaactactgtataattcaagtataagattatgtaattgtgtatattagcatcaatcatctttctttgttaaagaaccgactgtataaaatcatccaatgtaatctgcttttcttttatttgaataaaaaagtggacagataaaccaaaaaaaa

SEQ ID NO: 7203 - DNA, 784 bp, Artificial
  Synthetic
cccacgcgtccgattttttacacactaaattgttaaattgggtcacacaattcgtgtgttcggttctgttcttctgaaaccgaacattttagtatttcgattttcgagaaataatgggtttccctgttggttacacggatttattcctacccaaattgttagtccacgtactaacaattctgggttttataagaaagttcatttgcacgcttttcacagttctgggtcttggagatttcctcgaacccgaaatgtcatttccgacccgacccgaatctcactcggagctccactcagtgtcagcaacgttgatccgggagctgttgccggtggttaagttctccgaacttgttaacccgccggagagctgtgccgtttgtttgtacgaatttgatggggatgatgagatccgacgcctcacaaattgcagacatatattccaccggagctgtttggaccgttggatggatcatgatcagaaaacttgtccactttgccgtacgccgtttatccccgacgatatgcaagatagttttaatgagagattatggttggcttccggcatttctgatttttacggcgagtattctccggtcgccgccggtttgtagcactaccgatttttatttttccggtagttgggatttgataatgtaaaatgtatatactacaagagaaagaaaagaaaaaagatgagggaggaaaagattttaaaaaaaattactcctatttgtatagtgtacaattttgagactatggaaggaaaatcaatagattttgaact

SEQ ID NO: 7204 - DNA, 1115 bp, Artificial
  Synthetic
ctcatattcagaccctcattttccttagtattagctctccattaatttctcaccccccccccccccaaccaaatccccaactattatacaccacacctctccactagttatacccgtaacgcccactaattacacaaaactctgtaactcccacaacagttcatttcttgcttttcctcccttttttccaggccaagcttatttgacagagaatacacacaaggcagaaaaatggtttcttcttccaggctaacctttacacttgcttccttgttatgccttgtttggctgctcactatttcatctccggcaacagcttccttcgcttgccgttccggcggaacctgtgacgccattattgactacattttacctaacgccaccacctataacgccgttaaaaaactgttccatgtcaagaacctccgttccctcctcggcgttaacaacctccctatcgacacccctgctgaccaaaaactccccgctaatcaaaccatcaaaatcccattcccttgtctctgtagaaatggtaccggaatgtccaacaagcgacccacttacaccgtcgtatccggtgactccctttcacacatcgtctccgatatcttcgccaatttatttaccgttcaggaactccagacggttaacaacataaccgacccgaatgtgatacaaccaggagataagttttgggtcccacttccttgcagctgcgatgacgttgacggtgaaaaggttgttcattatggtcatttggtggccgccggcaacaccgtggatgccattgctcagcagtacaatgtttcccaggatacacttttgaaattaaatggtttatcagatccgaaagaacttatagctggctctgttcttgatgttccccttaaagcttgccaatcaatggtgagcaatacctcactggactatcctttgctcgtcccaaatgacacatatgtcttcactgctgccaattgtgtagcatgcaagtgtgatgctgcaaagaactggaccttgcaatgccaaccatctcagataaagtcctctctttggaagtcatgccccttgatgcagtgccaaggtctggatagcttttacattgggaatgccacgtc

SEQ ID NO: 7205 - DNA, 623 bp, Artificial
  Synthetic
gaattcgaaatctgatgaaggtttcgactgtaagggctctaccaaatgtatatctctagctggttatgtagcacccaacgctaccacctactcaagcatcgcatctctcttcgggataaaagatttgaatgttttactgggagctaattctttaccacctggaacttcagcaagcaaatcagtcgccgcgaaggagactgtcaaaatccctttcccttgttcttgtaataatggaaacggtatatccgatcaaactccggtttatacagtaaaagcaggggacggtttagatcacatcgccaggaatatatactcgttgttgattacatatgaagagatcgctgaagctaataatattcctgatgttaacaagattgaaattggccagcgtttgaatatcccacttccttgtagctgcgattctgtcgatggaaatccagtcgttcattatgcacacaaagtggcttctaaagaaactttagatatgattgggaagaagtttggggtagcggagaagactctattgcggctcaatgatcttgataatgctaaagacctcaaggctgaatcagttcttgatgttccattaaaagtttgtacgtctatggtaaactccacttcgc

SEQ ID NO: 7206 - DNA, 377 bp, Artificial
  Synthetic
gcagtggctcaacctcgacgtgtcaatctctcgttggttactcaagcaagaacgcaacaacgttgcgcaatatccaaaccctttttgccgtcaagaacctccgctcgatcctcggagctaacaatctcccactcaacacctcacgtgaccaacgcgtgaacccgaatcaagtcgtacgtgtcccaatccattgctcttgctccaatggaaccggtgtctcgaaccgggacatcgaatacaccatcaagaaagacgacatactctctttcgtcgcaactgagattttcggtggtctcgttacgtacgagaagatcagtgaggttaacaaaatccctgacccgaacaaaatcgaaatcggtcaaaagttttggatccct

SEQ ID NO: 7207 - DNA, 504 bp, Artificial
  Synthetic
gccattacggccgggatcttggaagtttaaaggaaaagggagaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctg

SEQ ID NO: 7208 - DNA, 668 bp, Artificial
  Synthetic
ggaggaaaagggagaaagagaaatctttctgtcttaagagtaattagcaatggcgggctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagctacctatgttcggatgcactgatgccacccaagtgttggctgaggtgggagaggcgaataaggaatacccacaggcctgggtccgtatcattggatttgacaacgtgcgtcaagtgcagtgcatcagtttcattgcctccaagcctgacggctactgagtttcatattaggacaacttaccctattgtctgtctttaggggcagtttgtttgaaatgtcacttagcttcttttttttccttcccataaaaact

SEQ ID NO: 7209 - DNA, 297 bp, Artificial
  Synthetic
tggtatcaacgcagagtggccattacggccggggatcttggaagtttaaaggaaaagggagaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaag

SEQ ID NO: 7210 - DNA, 332 bp, Artificial
  Synthetic
cccacgcgtccggaatgatcctaatccgtttagcttttaaaaaaataagaagacatatttatcaacttgatcaacttgagcaagttgcagcagatattttcctcggccaagatctagagttttgagaatggcgatggtatcaggaagacgatctactctaaaccccgacgcacctctttttattccggcagctgtacgacaagtggaagatttctcaccggagtggtggcaattggtgacaacttcgacttggtaccctgattactggatcagtcagcagcagcaaggcgcggatggtttctatgacaacggagagaatgagaatggtggag

SEQ ID NO: 7211 - DNA, 712 bp, Artificial; identical to SEQ ID NO: 4524
  Synthetic

SEQ ID NO: 7212 - DNA, 790 bp, Artificial
  Synthetic
cccacgcgtccgaaggctctctctgtctctttctcaaaatcatctgcaggaagtgaatcgtcaaaaccgagtttggaggatctgtcttgagggtttggttttttggatctaggagtttttttttggttgagaaatggcttcgaaacggatcttgaaagagctcaaggatctccagaaggatcctccaacttcctgcagtgctggcccagttgctgaagacatgtttcattggcaagctacaataatgggtccatccgatagtccttattcaggcggagtgtttctcgtaaccatccacttcccaccggattatcctttcaaaccaccaaaggttgcattcaggacaaaagtgttccaccctaatgtcaacagcaacggaagcatttgccttgacattttgaaagaacaatggagtcctgcactgaccatatcgaaggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcaaagactcggttttaatagagagaagagagaaagagagaggacttcttcacatagggatcttccatgaaataagttagattcctatgttttatcatctctctgtttgaaacctctttaatctcaaacaaaaacattccttctcctaaaaaaaaaaccaaaaaaagggcggccgcaccctaggccagt

SEQ ID NO: 7213 - DNA, 329 bp, Artificial
  Synthetic
aacctgatgatggatattaccacaatggtacgtttgttttcacattccaagtctctcctgtgtatccacatgaagctccaaaagttaaatgcaaaaccaaggtttatcatcccaatatcgatttggaaggaaacgtttgcctgaacatcttgcgtgaagattggaaacctgttcttaacattaacacagttatctacggactcttccatctgttcacggaacccaattctgaagatcccttgaaccatgatgctgcagcagttttgagggataacccaaagctctttgagaccaatgttcgcagggccatgaccggtggatatgtcggt

SEQ ID NO: 7214 - DNA, 498 bp, Artificial
  Synthetic
cccacgcgtccgagctcgtcaaagatgctttccaaaactagcctttttctttgcctttctttggctattttgctaatagtaatatcctcacaagctgatgcaagggagatgtctaaggcgcctgctacaataacccaagcaatgaagatgggtgcaggaatcaacggcgtcggcaaaggcgttggcaaagccgttggcaaagctgttggcaaagtagccggcaaagcttgtaaaatttgctcatgtaaatacaaaatttgcagcaaatgtcctaaatgtcatgattaaagttaggcctcagagactatgtacttgtgctggtgtgagtttagttttgagaataaagggaaagctatgaatagcctaatataattctattcactttgttttgttagtagttgcaacttgcaacaagtctttgggtcaaaatgtacctcgtcttgtagtctttcaactgtataacattgtactgtactgtattttgtctttagccacttg

SEQ ID NO: 7215 - DNA, 627 bp, Artificial; identical to SEQ ID NO: 5239
  Synthetic

SEQ ID NO: 7216 - DNA, 427 bp, Artificial
  Synthetic
gctgcaggggaattgcagctgaagagcttaattgaagcacatgtggaaaaaaccggaagcagcaaaggcgcaacgattctgaatgagtgggaaaagtatctacctctcttctggcaactggttccaccgagtgaggaagacactcctgaagcttctgctgcttacgtaagaacatccaccggggaagtcacatttcaatcggcttagagatcattcaagagcaggttgtggcagttgaaacacaaggattgatatacatcaatggtggaggactatggagagcagattaatggaaaatcattatcattcacatgtagatcaaatgtgtgggacaatattcttattgtcttgtgatctttacaacaataccatggttgctataactgtacagtaaattcagtaaaataactgctttcaactgtcaaaa

SEQ ID NO: 7217 - DNA, 85 bp, Artificial
  Synthetic
ggcacaaaaaaaattgaagcttggaatagctcatcaaaatggtttggaaaactaatctttttatttgtgtttctttggctatttt

SEQ ID NO: 7218 - DNA, 597 bp, Artificial
  Synthetic
cccacgcgtccggagagaagaatagtttgatcatcttgtgagaaaaataatggctgcttcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcatgtgtaatcatgtttctataaatgtttctgtgttgttctctttctctctaatgttgtaaaactcagacatactttgaatttataagacttctagtgtttgtataa

SEQ ID NO: 7219 - DNA, 629 bp, Artificial
  Synthetic
gccattacggccgggggagagccacatttactagttagagcagaagaagagagtataggaaatggcaagcacagtaatgagctcattgagcctcaaacctgcaactttcagtgttgagaagacagcagtgaaaggactgccatcacttgctaggtcttcttcttccttcagagttcaagctagtggtgtcaagaagcttaagaccgacaagccttacggaattaatggaagcatgagcttgagagacggcgttgatgcctcaggcaggaagcccaagggaaagggtgtttaccaattcgttgacaaatatggagcaaatgttgatggatacagccccatctacaacacagatgactggtctccaagcggtgatgtctatgttggaggcaccactggcttagccatatgggcagtcaccttggttggcattctggctggaggtgctctccttgttttcaacacaagtgctttggcacagtagatcattatccttgtactcctatttcagttgtattccagctcgcaccatgtatcttttcaagaatactttgtatttgctggcatcttgattaatctgtaattgctgtggatattacacataatgttgattatttaaggtatttgtgatc

SEQ ID NO: 7220 - DNA, 538 bp, Artificial
  Synthetic
gaattcccaacaactccattccaagagaaagttgctagcagtattcaaggccttccatccctagcaaggtcttccacttcactcagaatttctgccaatcaagttaagaagatcaagactgacacaccatatggaactggtggtggcatgaacttgaggggtggtgttgacgcatctggaagaaagcccacgggaaagggtgtctaccaatacaccgacaaatacggtgctaacgttgatggatacagtccaatctacaccccagaggaatggtccgaaagtggtgataggtacgctggaggtgtaactggtctagcaatttgggcagcaactcttggtggtattctacttggaggagctctccttgtttacaacaccagtgctctagcttcttagatgtcaatcaaattgttgtaatcccatgtgtatgttttcaacaagattttctaagtaaatggttgtctaatactctcttgtacgcccaaacttatttcgtaatttgtatgaatttggttgatgatatagtaccacaatttct

SEQ ID NO: 7221 - DNA, 127 bp, Artificial; identical to SEQ ID NO: 4624
  Synthetic

SEQ ID NO: 7222 - DNA, 609 bp, Artificial
  Synthetic
tttttaataatacaaatttaaaaagccacacttattttatttattatattgaaatagtacagtacatgaagagtacactatagaacaccagtactctatttattaattcttggggcaacttattctgaatcttccataatagtcccatagaactatttaattaacccatgctgggagtatctcgaacaatgagtttccagttaacaacaacaaaaactcgaccacaaacataattaagtggcctaaccataccagggaacaaaaactgaactttggctatgggattttctttctcaattattctcttagcagtcgccgctggctttcccacaagttcaggccatgattgctttcctgggcaaattattgagagagagggatcatcaagtgtttccacttggttttcttttgccattgggaattgcaagacttctattccgtcacttacttcgaatactagatctcttgccgtaagaggttgaaaaagcgatgcaaggagcaagaaagcaactacatgagataacttgaacatagtcttcccttccattgcctttgctttgaaaaatacaaagaaagaaaatccaaactgtattccccggccgtaatggc

SEQ ID NO: 7223 - DNA, 462 bp, Artificial
  Synthetic
cccacgcgtccgatcgactcatctctcagctcaccggtgctgcattatcaaaactgcaggaaggatttggttgtgaagatggcatcgaagttgatacaagttcaatcaaaggcatgtgaggcttcaaagtttgtggctaagcatggaacttcctactacagacagctgttggagaagaacaagcagtatatccaggaacctgccactgttgagaagtgccaagagttgtctaagcagttgctctacacccgtcttgctagcattcccggacgctatgaaaccttctggaaggaagtagactacgcaaagaacctatggaagaacagatccggtctgaaggtagaagatgcaggaatcgctgcattgtttggtctcgaatgctttgcatggtattgcgcaggtgaaatcgccggcagaggattcaccttcacaggctattacccatgaaggagagtaacaata

SEQ ID NO: 7224 - DNA, 534 bp, Artificial; identical to SEQ ID NO: 4633
  Synthetic

SEQ ID NO: 7225 - DNA, 450 bp, Artificial; identical to SEQ ID NO: 4631
  Synthetic

SEQ ID NO: 7226 - DNA, 668 bp, Artificial; identical to SEQ ID NO: 4629
  Synthetic

SEQ ID NO: 7227 - DNA, 610 bp, Artificial
  Synthetic
tctctcttccccaccttggttgaatattctccatcgacggggagagacaacaacaggcatggcctcactactgaagcaactgcaaggcaaagcatgcgtggcctcccagttcgtgtcgaaacacggatcgtcctactacaaatccctgatggagagcaacaagcagtacatcgcctccgagcccaccgttgagaagtgtcaggaactttccaaacaactcttttacacccgtcttgccagcttgcccgctcgatatgaacacttttggaaagagctggatctcgtgaagcagaaaatcaagaacaggcaagacttgaaggtggaggaggttgggattgctacattattttcattggagtgctatgcatggtattgtgttggagaaattgccggaagaggtttcactctcacaggctattatccttgacctttttcaagcttccatttaaaagtctaatagggaaccaaggagagagctgtttcagacaaaccttcctaataatgtcacctgtgtgaatttacatgactgcaatttttgcaattatccgactgagtcatggtcctttgtctccttttcagtctttttaaagatatttgttatatcatggca

SEQ ID NO: 7228 - DNA, 631 bp, Artificial; identical to SEQ ID NO: 1149
  Synthetic

SEQ ID NO: 7229 - DNA, 598 bp, Artificial
  Synthetic
tttaaaagataattgtgagaaatagatgataacccaaaggtttagcaatctcgagagtaaaaaaaaagaaaactcaaaaccaaagattataatggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggctatgctcggagccctaggctgcgttttccctgagcttttggctaggaacggagtgaagttcggagaagcggtttggttcaaggccggttcacagatcttcagcgacggaggattggactacttgggcaacccgagcttggtccacgctcagagcatcttagccatttgggctactcaagttatcctcatgggagct

SEQ ID NO: 7230 - DNA, 375 bp, Artificial
  Synthetic
ctcgagcttgcggccgcccgtattatacataaaatctcatgtatctttacatcaaacttcaaatctaaatacaaaaacaaaaagaacatcactagagatggatctctcgtcggacaaaaccccgaagtttcgtctttcacggtcaactttagtcaaactccgatccgaatcaaaccaaaaagggtttttcattcatcgatcatagtcatcatctcctttttagacaaaagattctcagcttctctggatcataaggaagagtctagagcaggagcgtcggatcccttcatgattctgagtctcttacaagaagaagagaacatgtcccatggaacatcaccaaccaacatccagtcaccatctttatcttcgtat

SEQ ID NO: 7231 - DNA, 1012 bp, Artificial
  Synthetic
tcgcgatctagaactcttattaactaaagagccttttacttgcgccacactctcaccgcaatggccgcctcgacaatggctctctcctctcctgctttgaccggaaaggccgttaagctatccccggcggcctccgaagtatttggaaccggccgaatcaccatgcgcaaagcctccaagcccaccggtccatccggcagcccatggtacggatccgaccgagtcaagtacttgggtccattctccggtgagcctccgagctacctcactggagagttccccggtgattacgggtgggacactgccggtctatccgccgatcccgagaccttcgctaggaaccgtgagctagaagttatccacagcagatgggccatgctcggagccctaggctgcgttttccctgagctattggctaggaacggagtgaagttcggagaagcggtttggttcaaggctggttcacagatcttcagcgacggaggattggactacttgggcaacccgagcttggtccacgctcagagcatcttagccatttgggctactcaagttatcctcatgggagctgttgagggctacagagtcgccggagatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtgagtttaatttgtgatcgagttgtgtgtatccggtttgttgcatcttggaaatgtgatgcagatttcatatcttgtaaattactttgtatgtgtgtgaaatatttaagaagctttatgataaaaaaaaaaaccaaaaaaggcggacgcgtggg

SEQ ID NO: 7232 - DNA, 887 bp, Artificial
  Synthetic
tggtatgaacgcagagtggccattacggccggggacagctattttctctattacttcagccatcaaaaaacacttatttctccttattaaaccatggctgcttctacaatggctctctcttcctcttcttttgccggaaaggcagtaaaactattaccgtcttcctctgaaatcaccggaaatgggaaagttaccatgaggaagactgctagcaagcccaagcctgtatcttctggcagcccatggtacggtcctgaccgtgtcaagtacttgggcccattctctggtgagtccccaagctacttgactggtgagttccctggtgactacgggtgggacactgctggactttcagctgatccagaaacttttgccaagaaccgtgagttggaggtgatccactgcagatgggcaatgcttggagctcttggttgtgtcttccccgagctcttggcccgtaacggtgtcaagtttggtgaggctgtatggttcaaggctggatcccaaatttttagcgagggtggacttgactacttgggcaacccaagtttggtccatgctcaaagcatcttggccatttgggcttgtcaagttgtgttgatgggagccgttgagggttaccgtgttgctggtgggcctcttggggaggttgttgatccactctaccccggtggcagcttcgacccattgggcctcgctgaagacccagaagcttttgctgagctcaaggtaaaagagatcaaaaatggtagacttgccatgttctccatgtttggattctttgttcaggctatcgtaactggaaagggcccattggagaaccttgccgatcaccttgcagacccagttaataacaacgcttgggcctacgcaacaaactttgtccc

SEQ ID NO: 7233 - DNA, 819 bp, Artificial
  Synthetic
aggactttggtcctacctagttatttatatacagttgctgcaaggccattaaactcaagccataaatcaaatattctttctgtgtagtagctgcattttcaagagcatttcactttatttctgcaacaatggcagcttctacaatggctctctcttcctcttcttttgccggaaaggcgctgaaactctcaccatcttcctctgagatcaccggaaatggaaaagtcaccatgaggaagacagttaccaaggcgaagccagtctcttctggcagcccatggtatggtcctgatcgcgtcaagtatttgggcccattctctggtgagtctccaagctacttgactggtgagttccctggtgactacggatgggatactgctggactttcagctgatccagaaacttttgctaagaaccgtgagctagaggtgatccactgtagatgggccatgcttggagctcttggttgtgtcttccccgagctcttggcccgtaatggtgtcaaattcggtgaggctgtatggttcaaggctggatcccagatttttagcgatggtggacttgactacttgggcaacccaagtttggtccatgcacaaagtatcttggccatttgggcttgccaagtcgtgttgatgggagctgttgagggttaccgtgttgctggtgggcctcttggtgaggttgtcgacccactctatcctggtggtagctttgacccattaggtcttgctgatgatccagaggcttttgctgagctcaaggtgaaggagatcaagaacggtagacttgccatgttctcaatgtttggattcttcg

SEQ ID NO: 7234 - DNA, 649 bp, Artificial
  Synthetic
cgtccgaaaattctttctgtgtgtagtagctgcattttaaagtatttctttttatttctacaatggcagctgctacaatggctctctcttcctctacttttgttggaaaggcagtgaaactctcaccattttcctctgaaatcactggaaatgggaaagttaccatgaggaagacggctagcaaggccaagccagtttcttctggtagcccatggtacggtcctgaccgtgtcaagtacttgggaccattttctggtgagtccccaagttacttgactggtgaatttcccggtgattatgggtgggacactgccggactttcagctgatccagaaacttttgctaagaaccgtgagttggaggtgatccactgtagatgggctatgcttggagctcttggttgtgtcttccctgagctcttggcccgtaacggtgtcaaattcggtgaagctgtatggtttaaggctggatcccaaatttttagtgagggtggacttgactacttgggcaatccaagtttggtccatgcacaaagcatcttggccatttgggcttgtcaagtcatgttgatgggagctgttgagggttaccgcattgctggtgggcctcttggtgaagttgttgacccactttaccccggtggcagctt

SEQ ID NO: 7235 - DNA, 820 bp, Artificial; identical to SEQ ID NO: 4656
  Synthetic

SEQ ID NO: 7236 - DNA, 758 bp, Artificial
  Synthetic
ccccccgacagctaacttctctattacttcagccatcaaaaaacacttatttttccttattaaaccatggctgcttctacaatggctctctcttccacttcttttgccggaaaggcagtaaaactctcaccatcttcctctgaaatcaccggaaatgggaaagttatcatgaggaagactgctagcaagcccaagcctgtctcttctggcagcccatggtacggtcctgaccgtgtcaaatatttgggtccattctccggtgaatctccaagttacttaactggtgagtttcctggtgactatggatgggataccgctggactttcagctgatccagaaacttttgccaagaatcgtgagttggaggtaatccactgcagatgggctatgcttggagctcttggttgtgtcttccctgagctcttggctcgtaacggtgtcaagttcggtgaagctgtatggttcaaggctggatcccagattttcagcgagggtggtcttgactacttgggcaacccaagtttggtccatgctcaaagcatcttggctatttgggcttgccaagttattttgatgggagctgttgaaggttaccgtgttgccggtggacctcttggcgaggttgttgatccactttaccctggtggcagtttcgacccgttaggccttgctgaagacccagaagcttttgctgagctaaaggtaaaggagatcaagaacggcagacttgccatgttttccatgtttggattctttgt

SEQ ID NO: 7237 - DNA, 359 bp, Artificial
  Synthetic
tggtatcaacgcagagtggccattacgccggggacagctattttctctattacttcagccatcaaaaaacacttatttctccttattaaaccatggctgcttctacaatggctctctcttcctcttcttttgccggaaaggcagtaaaactattaccgtcttcctctgaaatcaccggaaatgggaaagttaccatgaggaagactgctagcaagcccaagcctgtatcttctggcagcccatggtacggtcctgaccgtgtcaagtacttgggcccattctctggtgagtccccaagctacttgactggtgagttccctggtgactatggatgggatactgctggactttcagctgat

SEQ ID NO: 7238 - DNA, 616 bp, Artificial
  Synthetic
cctttttcgagcaccaaaatatcaatatcaacttcatcagaataatctaaaaacttttttagcctaccaaagtggaaagccaaagaaaaaaatgtcatctgagattttcaaagcaaccaatgacttaccggaaacagaaatctccggcctcaatttcaaggaaactgagctcagcctcggcttacccggcgaatcacgaaagcaaatctccggcacaaaacgtggaatctccgatgctatggaattaagcctagggagctctacttctgaagattatcactccaaaaatgaaatctctactggaaccaaacctcaagtgaaggcacaagtagtgggatggccacctgtgaggtcatacaggaaaaacatgatagacaagtgcaagtacgtgaaagtggcagtagatggagctccctacttgagaaaagtagatttggagttgtacgacagttaccagaagctgttaaatgctctacaaaacatgtttacttgcctaactatctgtaattttcaaagcgaaagcaagcttatggatattacaaatggtgtggaatatgtaccaacctatgaagataaagatggagattggatgcttgttggagatgttccttggaaa

SEQ ID NO: 7239 - DNA, 752 bp, Artificial
  Synthetic
catttatatacagttgatgcgggctcattaaactcaagccataaatcaaatattttttctgtatagtagctgcattttcaagagcatttcactttatttctacaacaatggcagctactacaatggttctttcttcctcttcttttgtgggaaaggcggtgaaactctcaccatcttcctctgagatcaccggaaatggaaaagttaccatgaggaagactgttaccaaggcgaagccagtctcttctggcagcccatggtatggtcctgatcgtgtcaagtacttgggcccattctccggtgagtccccaagttacttgactggtgagttccctggtgattatgggtgggacactgctggactttcagctgatcccgaaacttttgcaaagaatcgtgagctagaggtgatccactgcagatgggccatgcttggagctcttggttgtgtcttccctgagctcttggcccgtaatggtgtcaaattcggtgaggctgtatggttcaaggctggatctcaaattttcagcgagggtggacttgattacttgggcaacccaagtttggtccatgcacaaagtatcttggccatctgggcttgccaagtcgtgttgatgggagccgttgagggttatcgtgttgctggtggacctcttggtgaggttgttgacccactctaccctggtggtagctttgacccattaggccttgctgatgaccccgaggcttttgccgagctcaaggtgaaggag

SEQ ID NO: 7240 - DNA, 778 bp, Artificial
  Synthetic
tggtatcaacgcagagtggccattacggccggggatcacaactaactttgacatctcaaactagcaacctctcactttcctcttgataaaccatggctgcttctacaatggctctttcttccccttctttcgctggacaggcagtgaaactctccccatctgcctcagaaatcactggaaatggaagggtctccatgagaaagactgtcgccaaacccgtcgcatctagcagcccatggtacggtccagaccgtgttaagtacttgggcccattctccggtgaggccccaagctacttgaccggtgaattcccaggtgattacgggtgggatactgctggactttcagcagatccagaaacatttgccaagaaccgtgaactcgaggtgatccactgcaggtgggctatgcttggagctcttggatgtgtcttccctgagctcttggctcgtaacggtgtcaagtttggtgaagctgtctggttcaaagctggatctcaaatctttagtgagggtggacttgactacttgggcaacccaagcttggtccatgcacaaagcatcttggccatctgggcttgccaagttatcttgatgggagctgttgagggttaccgcgttgctggtgggcctcttggtgaggttgtcgacccactctaccctggtggcagctttgacccattaggccttgctgatgacccagaggcatttgctgagctcaaagtaaaggagatcaagaatggtagacttgccatgttctctatgttcggattctttgt

SEQ ID NO: 7241 - DNA, 582 bp, Artificial
  Synthetic
acgcgtcggtttgttcttgctgtagggcgcgagatttggatcgatccattgccgccgcgcgatgggtgtgaagattagattcgctcgttttggaaggaaaaagctgcccttctatcgaatctacgtcgcggacagccgatgcaagcgtgacggcagatttttggagaatgtaggctactacaatcccattactggcaaagatggtgagaagcaattcgccatcaagtcggaccgagtcaaatattggatctccgttggagcacagccttccaacgctgttgcgaggcttttggcaagaacaggtaaccttccaacagcgtatcctcaggggccgacgcgatcatcaccatctccttcggcggcgccggcggcggacgacaagccggacatgaccatctccgccaagctctccgcctcgccggctccaatgctggccgccaggacactctgcttctgctgacgacgtagacgtcgacgaatcgagcaagagcaaaatactacaaagaggtttgacatttttatctaaattatttaagttagctctcgaagtaagctctgactcttgatagcgatggagttctt

SEQ ID NO: 7242 - DNA, 915 bp, Artificial
  Synthetic
gaattcaagagaagctctaaaatctgtctcaaccaataagaaagcaatttaagatctcttattaaaaaactcaccattttgagtactctatttaagcaacccaactgcaacaaccacaaacatcatctccttgcaattcttatagcacttcaattttctcatccatccatatatcagttagccatggcagcttctacaatggctctatcttcacctgcattggctggtaaggcacttgttccttccagctctgaagttttcggtgaaggcagaatctccatgagaaaaaccgttgcaaagccaaaaaccgtttcatccagcccatggtacggacctgaccgtgttaagtacttgggaccattctctggtgaatctccatcgtacttaaccggtgagtttgccggtgattacggttgggacactgccgggctttctgctgacccagaaaccttcgccaagaaccgtgagctggaggtcattcactgcagatgggctatgttgggagctcttggatgtgtcttcccggaattgttgtctcgcaatggtgttaaatttggtgaagccgtttggttcaaggctggttcacaaattttcagtgaaggtggattggactacttgggtaactcaagcttggttcatgctcagagcatccttgccatttgggcaacacaagttatcttgatgggagcagttgaaggttacagagttgctggaggaccattgggtgaggtggaggacccactttaccctggtggaagcttcgacccattaggcttagctgatgatccagaagcttttgctgaattaaaggtgaaggaaattaagaacgggagattggctatgttctccatgtttggattctttgttcaagcaatcgtgaccgggaaaggtcctttggaaaatttggctgaccac

SEQ ID NO: 7243 - DNA, 733 bp, Artificial
  Synthetic
tctcagtaagccggttgatttttcgtagggtttcacactgtacttaaccaaatggctccagctaaagctgatccgtccaaaaaatctgatcccaaggcacaggcagctaaggttgccaaggccgtcaagtcaggatcaaccttcaagaagaagtcacaaaagataaggacaaaagttacattccaccgacccaagactttgaagaaagatagaaaccccaagtaccctcgtatcagtgcacctggaaggaacaaacttgatcagtatgggattctaaagtatcccctcaccaccgaatctgcgatgaagaagattgaggacaacaacacccttgttttcatcgtggacatcaaggctgataaaaagaagattaaggatgccgtgaagaagatgtatgacatccagacaaagaaagtcaataccttgattaggcctgatgggacgaagaaagcatatgtgaggttgactcctgactacgatgcattggacgttgccaacaaaattggaatcatctaaactagttacctgtttagaattttacgagaatttaaaatcttggatttgggtttttagatacacttgaatggaagtgccttctatttttcattttcattttgtgttttagagacatgttttgttctgtataagagaaatcaactttaagctgcagttttctttctcgaaattctctgaatcctaacctgtcttcccaaaaccttaagagtcggagggg

SEQ ID NO: 7244 - DNA, 710 bp, Artificial
  Synthetic
cccgggttttctcctcagccgtcgtctccctcctcgcttcgcgtccgccgccgccgtcccggagaggtaagttcaagaggcagccctgtgaagctccaatggctcctaaagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagcta

SEQ ID NO: 7245 - DNA, 882 bp, Artificial
  Synthetic
atccagagcaatggcgttgcaaacgcagccggtagcaaatgcgtcacctcttcatgttcttcggtccgtatgcgtcctcctcctggccgcgtcggcgacggtggcggcgcggcgccacggcccggcggcgcccatcgccgggcagagcatgtacctggcgccgagctgccgcgcgcacacggcgtcgctgacggacttcggcggcgtgggcgacggcacgacgtcgaacacgacgccgtcccggagaggtaagttcaagaggcagccctgtgaagctccaatggctcctaaagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgactta

SEQ ID NO: 7246 - DNA, 591 bp, Artificial
  Synthetic
gcaagggaagaaggtaggaaggtaagtgtcaaaggttcagccggactccagcgatggctcctccgacaaaaggtgcagcggcgaagacagactcgaaggggcagaccactaaggctgccaaggctgctaaggcactgaagtccaatgtccatctgaagaagaagacacggaaggtgagaacttccgtcaccttccacaggcctaagaccctgaaaaggactagaacccccaagtaccctcgtgcgagtgccccacaccgcaacaggctggaccattacgaggtccttaagtaccccttgaccacggagtctgccatgaagaagattgaagacaacaacactctggtcttcattgtggacctccgtgccaacaagaagtccatcaaggatgccgtcaagaagatgtacgacatccagaccaagaaagtcaacaccctcatcacgccgaaaggattgaagaaagcttatgtaaggttgacagctgattatgacggtttggacgtggctaacaagattggtattatttaaattagatttgattagaatagagttggttatatgtctttctcaaggcttctggttaaactaaatt

SEQ ID NO: 7247 - DNA, 582 bp, Artificial
  Synthetic
tccgtcggaggcaagggcagtgaaagttttggcgatggctcctccgaccaaaggtgcagttgcaaagacggattccaagggccaggctgtgaaggcggccaaagcactcaagtcaaatgtccatttgaagaagaaaaccaggaaggtgaggacttcggtgaccttccacaggcccaagaccttgaagagggtgcgcacccccaagtacccccgcctcagtgccccccaccgcaacaagctcgaccactacgaagtcctcaagtaccccttgaccactgaatctgccatgaagaagatcgaggacaacaacacccttgtcttcattgttgatctccgtgccaacaagaaacagatcaaggattccgtcaagaagatgtatgacatccagacaaagaaggttaacaccctcatcacgcctaaaggattgaaaaaagcatatgtaaggttgacggcagactatgatggcttggacgttgcaaacaagattggtattatttaatcaaggtattggactacaacccagggcgaatttttttctgtagtcttttagtcaaaagacctcgcgtgtactgggcttaactc

SEQ ID NO: 7248 - DNA, 560 bp, Artificial
  Synthetic
gactttcaacaatggccgccactcaagctcagaacgccaagaaggctgccctcaagggtaccaacggctccaagaccctcaagtaccgatcctccaccatcttccgacgacccaaggtccttgagctccccaagaagcccctgtaccagcgaaaggccgttgctcactacccccgaatggactcttacgatgtcatcatctctccccttaacactgagactgccatgaagaagatcgaggactccaacacccttgtcttcattgtcaacaagaaggccaacaagtaccagatccgagatgctatcaagaagctctacgaggtcgagattgcctctgtcaacaccctcatccgacccgacggtaagaagaaggctttcgtccgactcaccgccgaccacgatgctcttgacattgccaacaagatcggttacatctaaacaactcttttattagggaagttacaaaaggcatttagccatctcaaaaggtgtcatttagaaaatgcactaatgaacacatttgcgagcaatcgatattatttatcgaacaaaaaaaaaaaa

SEQ ID NO: 7249 - DNA, 526 bp, Artificial
  Synthetic
agcgatggcaccaggtaagcagcgccgcgacgacaccaagagcaaggcggccaaggcggccttgtcggccaagagcgtcaagaatccggccccgaagatgcggcggaggaagatcagaacctccgtcacattccaccggcccaagaccctgaagcaggcgaggtccccaaagtatccccgcctgagcgcccccaaccgcgagaagctggaccactacaaggtgctcaagtacccgctcaccaccgagtcggccatgaagaagatcgaggacaacaacaccctcgtcttcatcgtcgacatccgggccgacaagaagaagatcaagaatgccatcaagatgatgtacgacgtccagaccaagaaggtcaatactctcatcaggcccgacggtttgaagaaggcgtacgtgaggctcaccccggacattgacgctttggatgtcgcgaacaagattggcatcatctagaagagcaagcttaaaatggggtttgtgtatcgctttaatgcaaagtttatggtttttttc

SEQ ID NO: 7250 - DNA, 656 bp, Artificial
  Synthetic
cgtccactactacgaatcgccagccgccacaccgagctccgccgccgccaaccccaccgcggcgagctccgccttccgccggccgcgatggctcccaaggccgctgtaaagaaggctgatggaaagactcaacaagccttgaaggttgccaaggcagtgaagtctgggtcaatcaagagaaagtcaaagaagatccgcacttcggtgacatttcacagaccaaagaccctgaagaaggcgagagaccctaagtacccaagagtcagtgcacctggcaggaacaagcttgatcagtaccaaatcctcaagtacccccttacgaccgaatctgccatgaagaagattgaagacaacaacacccttgtcttcatcgtcgacctcaaggcagacaagaagaagatcaaggcagctgtcaagaagatgtatgacatccaggcaaagaaagttaacactctgatcaggcctgacggcaagaagaaggcttacgtgaagctcactccagactatgatgctcttgatgtggccaacaaaattggcatcatttaagttagggcgctttttttcatcatgttgaacgtaagattttggttggctagttcttaatgttgaacagaaccttataacttgcaaaagaacatcttgagttttgttgagcg

SEQ ID NO: 7251 - DNA, 623 bp, Artificial
  Synthetic
gctctccgtgcaaattcgacaccaagccgatacaatggcccccgctaacaagaaagctgccgccaagggctccaagcaggccaacgccgctgccaaggccgccctcaagggtactcactcctccaagaaccgcaaggtccgcctgaccacctctttccaccgccccaagactctggtcctgtcccgcgctccccgctacccccgcaaggccatcaaccacgtcccccgtcttgatgagcacaagatcatcatccaccctctcaacactgagagtgccatgaagaagatggaggagaacaacaccctggtcttcatcgtcgacgtcaaggccaacaaggcccagatcaagctggccctcaagaagctctacgacattgacaccgtcaagatcaacaccctgatccgccctgacggctccaagaaggcctacgcccgcctgacccccgatgtcgatgccctcgacattgccgccaacaagctgtccctggtttaagctggataatttgttgagcagaggtcgttttttctttagtctttcttttttctcggcaacggaattggtctggtcttgaatgcgtgcgcacaacacaataaaagcatgggcatcggaaactatgggagtt

SEQ ID NO: 7252 - DNA, 563 bp, Artificial
  Synthetic
ctacaacgctctgtgcccggggttcgtgcagacgagctcgcggatcgccatcggagcctccatctcgccggtgtcgtcggtgggagggccacagtacgacatgacgctcctggtgtggaaggaccccaagctcggcaactggtggctcagctacggcgacggcgccggcggcctcgtcggctactggcccgccgagctcttcacccacctctccgaccacgccaccatggtcgagtggggcggcgaggtcgtcaacacccacccgcccggctccgcccacaccgccacgcagatgggctccggccacttcgccgccgagggcttcggccgggccgcctacttccgcaacctcgagacggtggacgccgacaacagcctcgccgcggtacccctcgacgccatccagacaatggcggaggacgccggctgctacgacatccgcaaggcctacgacgacgacgacggccgaggcggatggggcgcacacttctactacggcggccccaggccacaatacggcctcttgcccctaagcgcttattaattaattacctcatccaata

SEQ ID NO: 7253 - DNA, 693 bp, Artificial; identical to SEQ ID NO: 4635
  Synthetic

SEQ ID NO: 7254 - DNA, 675 bp, Artificial
  Synthetic
acgcgtcggtgtactgttatgaaacgtattggtcctagttggcgtatctggagcaagtcagacaacacatgtctcgacttccatcgattgatcccaataccagaactttactgatttgtggatatcctaacgttggcaaaagttccttcataaacaaggtgacccgggcggatgttgatgtgcaaccttatgcattcactacaaaatcgctctttgttgggcacacagattacaagtatttgcgttggcaagtcattgacacgcctggcatcctcgaccaccctttggaggaccggaatacaatcgagatgttgagtgttactgcattggcgcacttgcgtgctgctgttttgttcttcatcgacgtttctgggtcgtgtggctacagtattgagcagcaagctgctctcttccatagcatcaagcctctctttgcgaacaagccgttgcttatcgtttgcaacaagattgatttgcagccgttggagacgctctcggaggaggagagcaagctgattgcggagatgaaggctgaggcggcgcagctctcgtcaggtgttatgtcgagtgatacggtggatgctgatggttgcttgctttgcatgagtgcgctaacagaggaaggggtgatttcggtgaagaacgctgcgtgtgagcggctactccaacaacggg

SEQ ID NO: 7255 - DNA, 453 bp, Artificial
  Synthetic
acctagacactgaagacagtgaacacagctgcggtgaaagccgaacatattgataattctgaagataaatcatgctcattaggagttcataaatacaagagtcttatcggaattcatgctaagaaacacaggggtgggttcgccgcgtctctcacgctggatcctagtaaggttgaacgcctcagtttgagtgagcaacagcttgaaaagggagcggaggattatggaaccgaacttgtcagattcacccagcggaatctgctgcggatatatccaaaaggaacaaggtttaattcatcaaattataacccgatggttgggtggatgcacggagctcaaatggtagcatttaacatgcagggatatggcaagaaactgtgtttgatgcagggaatgttcagatcgaacggaggatgtggttatgtgaaaaaacctgatcttttaattacaaca

SEQ ID NO: 7256 - DNA, 628 bp, Artificial
  Synthetic
tagctttgatagtgatcttggtgttgttggtggactggatggaccatctctgtcggatgagactgaggaggacttcctctcaatgtaccttgacatggataagtttaattcgtcatccgtgtcttctgattttcaagagggcgagtcttcgtcttcggcagctgcagcttcaggttcattgcaaattccagcaatggcttcagcagcttcagggtcagataatgtgggccccactgctagtgcgaagtcaagggttagacatcagcatagccagtccatggatggttcaactacaatcaagccggagatgctcatgtcaggtatagatgaggcatctccacttgaaactaagaaagcaacgtctgcagcgaagcttgctgaactcgctcttgttgatccaaaacgtgccaagcggatttgggccaacaggcaatcagctgcaagatcgaaggaaaggaaaatgaggtatatagcagagcttgagagaaaagtgcagactttgcaaacagaaacaactactttgtgtgctcaattgaccctattgcagagggatacaaatggtctgactgctgaaaacagtgaacttaaactgcgtttacaaacaatggaacaacaggtgcatctgcaa

SEQ ID NO: 7257 - DNA, 644 bp, Artificial
  Synthetic
accgggtcgacccacgcgtccgctctctatggatattgatatggataagtttaatatttctgctacatcttttgcccaagttggtgagccatcaggaactgcttggaaaaatgagacaatgatgcagacaggcacaggctcaacttccaatcctcagaatacggttaatagtcttggcgaaaggccgagaatgatgcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaact

SEQ ID NO: 7258 - DNA, 571 bp, Artificial
  Synthetic
cctcgcgctgtccaaggacctcatggcggtcgccggcgacgcgctgaagacgaacatcacgacgctgggtcccctcgtcctgccgctgtcggagcagctcctgttcatggcgacgctggtcgccaaaaagctgctcaagatgaagaacgtcaagccctacatccccgacttcaagctggcgttcgagcacttctgcgtgcacgccggcggcagggcggtgctggacgaaatcgagaacaacttgtcgctgggggagtggcacatggagccgtcacggatgacgctgtacaggttcgaaaaacacgacctggttcgaagtctcgtccattctaattatttgatactccctcttttcacaatgtaagttattttagcatttttcatattcatattgatgttaatgaatctaaacatacatatttatctagatttattgacatcaatataaatgtgagaaatgttagaataacttacattttaaaatagatcattttttaatattcacgtctttactttttttcgctgtataggttggggaacacgtcgagcagctcgctgtggtacgagctgg

SEQ ID NO: 7259 - DNA, 623 bp, Artificial
  Synthetic
ataaatcatatagatgtgtacaacaacaagaagatcctgagaggaaaagttggtataaatttgtgtataaatttaatgcaagttgcaggagaagcattgaagtctaatattactacaattggaccccttgttctgcctgcttcagagcaacttctctttcttctgactctcattcgtcgaaaaattttcaagaaaaattcgaaaccatacgttccggactttaaactagcgtttgagcatttctgcatacacgccggaggaagggcagtgatagatgagctgcagaaaagcctgcagctatcggcggagcatgtggaggcttcaaggatgacgttgtatcgattcgggaacacgtcatcgtcgtcgctatggtatgagatgagttacattgaggcaaaggggagaatgaaaaaaggtgacagaatttggcaaattgcatttggaagtggattcaagtgtaacagtgcaatttggaagtgtaatagaacaatcaagactccaataactcataatccatgggctgattgtattgacagatatcctgttgatattccagatgttgttaagctctagtctttatactgtaatcaatgtattaagttaattaattaattccctcttct

SEQ ID NO: 7260 - DNA, 638 bp, Artificial
  Synthetic
aagattctaggaaatgcacgaggcagattttcatggaggggtcaaagttgactggttcgttccctgatgaaactcttgagttccaaaggaaaattctcgagaggtctggacttggtgaatctacttatctcccagaagccgtgttgagggtaccgccaaatccttgtatggcagaagcaagaaaagaagctgagattgttatgtttggtgccattgatgaactccttgctaaaaccggtattaagccaaaggatattggaattctagtagtaaattgcagtttgtttaatccaacaccatcattgtctgcaatgattgtgaaccattacaagcttcgtggaaacattgttagctacaatctcggtggaatgggttgcagtgctggtttgatctcgattgatcttgcaaaagatcttcttcaagtccatcccaatacttatgctttggtgctcagcatggaaaacatcactctgaactggtattttgggaccgagaaatccatgctccttccgaattgcttattccggatgggaggcgctgctgtattgctctccaacaaaggatctgagcgaagaagatcaaagtaccagttggttcatactgtcagaactcacaaaggttctgatgacaagtgcttt

SEQ ID NO: 7261 - DNA, 1195 bp, Artificial
  Synthetic
gcgtccggacttatataccagtagataaatggattccatcaaatttttctcttagtagtaatcaacatcaagctaaattggttattgttggtgccatagacgatctgttggcaaaaacaggagtgaaaatcagagagatcgggattgttgttgttaattctagtatgtttaatccaacaccttctctttctgctatgattgtcaaccattataagcttggagttaatgtgattacttataatcttggtggcatgggttgcagtgctggacttatttctgtggacctagctaatcggcttttacaggggaaagcaaacacctatgcacttatagtaagcacggaagtagtctcaacggccttctatacagggaaagacaaatcaaagctaataccaaatatgattttccggatgggtgcttctgctgttctcctttcgaaccgtttctcggatcgttggcgctcaaaatatcaactgatgcatgttgtccgcacccataaaggtgcagatgacagagcattcggttgcgtctaccaagatgaggaagaggatggaaaaaaaggcatgtcattgtcaaaagacttaatggcagtagctggtgaggccttaaaaacaaatattactactttgggccctctagtcctcccaatgtccgagcagctcctatttttcgtctctttagtcgtgagaaatgttcttaaaaggaaaataaagccatatatccccgatttcaagatggcattcgagcatttctgcattcatgcaggggggagggccgtgttggacgagcttcagaagaatcttgatctcacagaggaacttatggaaccttcaagaatgactctttataggttcggaaacacttcaagtagttcagtgtggtataatttggcctactctgaggccaaagggaggataaaaaagggtgacagagcatggcaaataggttttggctcaggattcaaatgtaacagtgctgtttggcgtgcgctaaggaccgttgatgcagccattgaaaagaatgcttggacagatgagattgaggatttccctgttcaaattgcatattgatgatcagtactgaaaccataaaacacattcaaaatcactctagtatatttgtatatgggattgtgcacctaattttgaacaagcgaggaatctggaattaataaatttaagtaagatggggggca

SEQ ID NO: 7262 - DNA, 720 bp, Artificial
  Synthetic
cccacgcgtccgcccacgcgtccgcacacctaattattacaaaggttcagagagagcaatgcttctaccaaattgtttgtttcgtatgggtggtgcagccatactcttgtccaacaaaaggcgcgatagatacagagccaagtacagattaatgcacgtggtccgaacacataagggtgcagacgataaggcatttaaatgtgtattcgaacaagaagatccacaagggaaagttggtattaatttatcgaaagaccttatggttatagcaggagaagctttaaaatccaacattactacaattggtcctttagttcttccagcatcagagcaactcctttttctcctcacacttattagtcggaaaatttttaatcccaagttgaaaccttacattccggattttaaacaagcgtttgaacatttttgtattcatgcgggcggtcgggctgttattgatgagcttcaaaagaacctgcaattgtctgctgaacatgttgaggcatcaagaatgacattgcatagatttggtaacacttcatcttcttcactatggtatgagatgagttacattgaggctaaagggaggatgaagaaaggtgatagagtttggcagattgcatttgggagtggatttaagtgtaacagtgttgtttggaaatgtaacagaacaataagaacaccaactgatggaccatggcaagattgcattgataggta

SEQ ID NO: 7263 - DNA, 376 bp, Artificial
  Synthetic
aataatcaagaagcgtcacattaagagtacaagagcttaaccagaaaagaagaaaaataaacaaggcagagtctagtaagactaggactaaccaaacaaatggtttttcattaaatcagaagtcgagcttaaccggatatcggtcgatgcagtgttcccacggactactaaccgaaggcttgacattgtttagagccacccaaactgcactgttacacttaaacccacttccaaaagcaatctgccaaacccggtttcctttcttcatcctacctttagcctctatgtaagccagttcataccaaatcgagctcgaagaagtgtttccaaatctgtgcagtgtcattctggatgcctcgacatgagtctgcgaaag

SEQ ID NO: 7264 - DNA, 1176 bp, Artificial
  Synthetic
tattatccacattttgttgaaaaatgggcactctcaaccagacagagcaacccatgtccaagcctcatgcagtatgcattccatttccagcacaaggccatatcaatcctatgcttaaattagccaaactcctccatatacgaggctttcatatcacattcgtcaacactgacttcaaccaccggcgattgctcaaatcccggggtcccaatgccctctctggcctaccttcctttcgtttcgagtccatccctgatggactcccaccctctaacgatgacgcgacacaagatgttccatctttgtgtgagtcatgtacgaagttgtgtttggccccttttagagaacttgtcacgagactaaataattccttgaattttcctcctgttacttgcatagtttctgatgctggtatgagcttcacccatgaagtttctgaggaattgggtattcctaatgttgccttttggactgctagtggttgtgccttgtgggctttcctacaatatcctaaacttgtggaagaaggttattgtccagtgaaagatcatagttacttgaccaacggccatttagacaccattatagattggatacctggcatggagggcatccgtcttaaaaatctgccaagcttcatcagatccacagtcgacgaacctagctatatggtaatcaaatttataatggaagaaatcttggacaaaattcccaaagcttcagcactcattttgaacactttcgatgcgttagaaactgatgttctgaagccaattttgaccttgttcccaacggtttatactcttggaccctttcacacttccttgaataatcaaactcaagacgaagatttgaaatcaattggttcaaatctgtggaaagaagatactcactgtctcgaatggctcaacactaaaaaaccaaattcagtcgtatatgtgaattttggaagtattactgtattgtctcccaaacagctggttgaatttgcatggggacttgctaattccaaattgaatttcttgtggattattagatcggatattgtcaagggtgattctctcattttgccacctgaattgctcgcggagattaaggaaagaggtttattatgtggttggtgccctcaagaacatgttttatgtcacccatcagtaggaggatttttaacacact

SEQ ID NO: 7265 - DNA, 680 bp, Artificial
  Synthetic
gttttaatcagctaaagaaaaagaatctgatgatgtgggaccttttactgaaggaaatatgcaaatcatgttaatgagtacctctagaattattgaggcaaaatacatagattattcttctgaattgagcaattggaaagttattccagttggtccatcagtccaagattcaatggctaatggcacggatgacgtggagctttttgattggctaggaaaaaaagatgagaattcaactgtatttgtctcttttggaagtgagtattttttgacaaaagaagatagggaagaaatagcttttggattggagtttagtaatgttaatttcatatgggttgtaagatttccaaatggggaagaacaaaatcttgaaaatgctctaccacaaggttttcttgaaagaattggagaaaggggaagagttttgaacaaatgggccccacaaccaagaattctcaataacccgaatatcggaggatttataagtcattgtggttggaattctgtaatggaaagcgtagattttggagttcctataatagcgatgcctatgcatcttgatcaaccagtgaatgctaggttgatggcagaactaggagtcgcggttgagattgttagaggtgatgatggcaagattcatagagaagaaatagcgcaagttcttgaaaatgtcatagctg

SEQ ID NO: 7266 - DNA, 631 bp, Artificial
  Synthetic
ccgagtggctcgacaccaagccggccggctcggtggtgtacgtcgcgttcgggagctgaaccgtcatggcgaaggggcaggtcgacgagctgctccatggcctcgaggagagcgggaggccgtacctctgcgtggtgcggaaggacaacaaggccgccgtggcggagacgggcgacgcgacggcggcggcggcggcgcgcaggaacggcgtggtggtggagtggtgcgaccaggtgcgcgtgctgtcgcacgcggcggtggggtgcttcgtcacgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttata

SEQ ID NO: 7267 - DNA, 557 bp, Artificial
  Synthetic
cccacgcgtcgcccacgcgtccgcgacaaccgcctcccggacgacgcgtcgtacggcttccacctccacacgccgatggcggcggcgtgccgggagtggctggacgcgcggccggcgggctccgtggtgtacgcctcgttcgggagcatcgcggcgccggggccggagacgatggccgaggtcgccgagggcctctacagcagcggcagcccattcctctgggtggtccgcgccacggagaccggtaagctccccgccggcttcgccgccagggcgaagaacaccggcctcatcgtgccatggtgcccgcagctggaggtgctcgcgcacgccgccgtgggctgcttcgtgacgcactgcggctggaactccaccgtcgaggcgctcagcgccggcgtgccgatggtggcggtgccgcagtggtcggaccagacgacgaacgccaggtacatcgaggacgtgtggcgcgtcggcgtgcgggttcgcggcggcggcggcggcgacggcggcgcggtggtgaggagggaggaggtggagaggaaggtgagggaggtgat

SEQ ID NO: 7268 - DNA, 624 bp, Artificial
  Synthetic
  misc_feature (312)..(312): The residue at this position can be any nucleotide.
aaggtgagtccgccgggccccagaacgtcttgctgcgtgagcaaagcctcgagtcaatccagtggctcaacaagcaggagaagtcttcggtgctctacatttctttcggaagcctggccgccctcaccaggcagcagttcgaggagctggcagaatctctcgaagagttgaagcagccattcctgtgggtggtgcgaccggagctcttcatcgacttcatgcatgaatttcaaactctatatgacaacttctgtgagagaacgaggcagctcggcatggtgatacattggggaccgcagcttcaaatcctgnaacacccgtctattggagcatatctcacacactgcggttggaactccctcatcgagagcatctccaacggcgtcccgatgatcgcttggccgtggggagcggagcagaacagcaacgccaaactcctcaccgacgactggaaagttgccttcaaaatccccaccaaaggcttcttcgatctggttccaaaagcggaggttgtcaaggcaatcaaaactgtgatggactttgacaacgtcgacggcgctgccatccgaagcaatgtactacgtctgaagaagctggccaggaaggccgttgtcgggggtggtc

SEQ ID NO: 7269 - DNA, 670 bp, Artificial
  Synthetic
gaaagagatgcttcctcttgcctaccgaacacccaacgcatttaccacgaatctggcagttgcagcgaagcgaacgaaaactgccgcatgccttcttatcaacacgatcgaagagctggaccagaaactcgtggacgtgcgcaggtccgagttttccagctacttagcagtcggacctctggtgtcccaagcgctactacaagaacaggatactgcagtcagttccacaagtgacgattctctgagctggttggacaagcacgctcaccgttcgattctctatattgcctacggaagcgttgtgtccctgaaagttagcgacgcccagaagatagcggaagctgtgaaagcaagtcgtcagccggttttgtgggcagtaagacggaagttcgcaggcgacgtacctgagaacttctacgaaagcttgcaagaaagagctgggacgcaagctttgatcgtggaatgggctccgcaagtggctgtgttgcgccaccctgcagttggggccttctggacgcactgtggatggaattcggctctggaagccttgtgcacgggagtaccgatgctttgctggccctgcgcagccgatcaaaacgtcaatgcaaacacgatagtgaccaattggagaactgggatgatggcgagtaatggaccacaagatgacgcg

SEQ ID NO: 7270 - DNA, 651 bp, Artificial
  Synthetic
agatgaaagttgtttcacaaatgggtatatggacacgggaattgactggatacctggaattaaaactatcttgtttaaagatattcctacattcgttcgaacaacggatcctaatgacgccatgttgaattatattttaaaagaagctgcccgaacctatgaagctacagcattgattttcaatacttttgatgatttagaaatggagttattggatgaattcaagtctcagctaccagtaccactgcctccaatttacaccgttggtcctattcacaatctccacaatcaaattccaaaccataaattgcagtctatcggatcaaatctatggaaagaagatacccaatgtctacaatggctggattccaagaaacctgattcagttgtgtacgttaattttggaagcatagctgttatgactgctcaacaactagtagaatttgcttgggggctggctaatactaaacacagtttcttatggatcatccgacccgatctggtagttggtgcgtcagcaatgctgccccctgagttcttagaagaaaccaaagaaagaggtctgctcgcaagttggtgtccactggaatacgtgctgaatcacccatccatagctggtttcttaacgcactgtggttggaattcaatttt

SEQ ID NO: 7271 - DNA, 584 bp, Artificial
  Synthetic
atcattggtcttgagatggcttccgtttggtcacgtctgggagccaaggttaccgttgtcgagttcctcggtcagatcggtggacccggcatggacaccgagatctccaaggccactcagcgaatcctcaagaagcagggcatcgagttcaagctcaacaccaaggtcgtcagcggtgacaccagcagcgagctcgtcaagctcgacgtcgatgctgccaagggcggcaagcccgagagcattgattccgaggtagttttggtcgccattggacgaagaccctacacccagggtctgggcctggagaacattggcctcgagacggatgagcgtggccgtgttatcatcgactcggagtaccgaaccaagatcccccacatccgctgcattggtgacgttacctttggacccatgcttgcccacaaggccgaagaggaggctgttgccgtcgtcgagtacatggcaaagggccacggccacgtcaactacggatgcatcccatctgtcatgtacacccaccccgaggtcgcttgggttggccagtcggagcaggaccttaaggctcagaacatcccctacaagat

SEQ ID NO: 7272 - DNA, 331 bp, Artificial
  Synthetic
cccacgcgtccgtgctgaaggtggagaacagaccactctagaagctgatgtggtcctcgtctcagctggtagaactccgttcacatctggacttgatctagagaaaatcggagttgagacagacaaaggcgggagaattctggtgaacgagagattctcgacaaatgtttcaggcgtttatgcaattggagatgtgattccaggaccaatgctggctcacaaagccgaagaagatggtgttgcatgtgttgagtttatagcaggcaaacacgggcatgtggattacgacaaagtccctggggttgtctacacgtaccctgaagttgcgtcg

SEQ ID NO: 7273 - DNA, 656 bp, Artificial
  Synthetic
ttatcacaacatcgactttgtttcttcaccggagagttgactttttccaattgtctcatcactaacttgatcagccggtaaatttaggtcaaacttgtggctattgtcaccgttactgttaccgttaccaccatcatagtgacaacgtttgtgaccacccaatgcttgaccagagggaaacgacttaaaacatatagagcagttatgagtcttcccactttgaccaactaaaccgttactaatatttccgttattagtaacggttccgttactattattaacatcgacactaaccggtttccggtgacttgttttgtgtccacctaacgcttggtaagacgggaaagatttgccacagacggaacacttgtaatctttctgatgatcggacagtggagaaagagagtgatgatccgacggtggagagtgatgatcggaggagccacgagcgagcataaggaggcaaagagcgagatactcttcttcagaaggaggagggtttggttgatctatacggtgacgttttgtacgttttcttttggtccatgattcgaggttttcgggctcggtttcgtcgaggcaacggaggaaaggaggaggagcggtggttgtggtggtggaggtgggagaattgagagtgtcgagagccatgctgc

SEQ ID NO: 7274 - DNA, 380 bp, Artificial
  Synthetic
ctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttt

SEQ ID NO: 7275 - DNA, 336 bp, Artificial
  Synthetic
cggacgcgtgggcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgaca

SEQ ID NO: 7276 - DNA, 279 bp, Artificial
  Synthetic
cccacgcgtccgcggacgcgtgggaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccacc

SEQ ID NO: 7277 - DNA, 185 bp, Artificial
  Synthetic
attttgtaattgacacctcatcactcaagtatcatcttgaacagatatttcctccctcttgtataattatccaaagtactttcaacttaatgtttgtgttgtgcatattcatatgtgtaataaagtcaggagctgtatgtcaaagtgtaaatgccatcggttcgagtttcattgagttttgatca

SEQ ID NO: 7278 - DNA, 126 bp, Artificial
  Synthetic
ccctcgacccacgcgtccggtatcgtcaagtgaggacattgcttttacatgccatgcacatccaacaacgagtgaggctctgaaagaagcacacatggcgcacttacgacaagcccattcacatat

SEQ ID NO: 7279 - DNA, 336 bp, Artificial
  Synthetic
gtgctggagagataatacatgaggctgtccttgctttgcagtatggagcatcaagtgaggacatagctcgtacatgccacgctcatcccaccgtgagcgaagccttgaaggaggcctgcctgcaaaccttcacaaaggcgattcacatttaagttctgttttgcttttaacatccaaactgcttggcttcacaaattccaaaattttgtaataattttggatatatgggatcaaaaagccactgtttgtcattttactctcgttcgtgatgctgtgaattgacactagttgccacagccaatagtatatgctattgattccattcccttagatgct

SEQ ID NO: 7280 - DNA, 614 bp, Artificial
  Synthetic
gtgaagaccaagttgtcaagtggaggaatccggatccgggctcaagctttccctggaagcggcaaccggtggcacaccatcgactttggaagcagacgtggtgttggtcgcggcgggaagatctccatacaccaagggtctcggactggacagcgtggggatcaagctcgacaaagctggccgagtggaagttgacgaccacttccggactagcgtccccagcatctacgccatcggcgacgtgatccggggtcccatgctggcgcacaaggccgaggaagatggggtggcgtgcgtggagctgatcgccggcaaggccgggcacgtcaactacgacacagtgccgggtatcgtctacacgcatccggaggtggcatcggtggggaagacggaggagcaagtcaaggcgctggggatcccgtacaacgttgggaagttcccgatgatggccaacagccgagcgaggacgatcgatgatgcggaggggatcgtcaaggtcattgcggagaaggagagcgacaagatactggggattcacataatggcggccaatgccggggagatgatccacgaggcttgcattgcgctcgagtatggtgcttccagcgaagaca

SEQ ID NO: 7281 - DNA, 650 bp, Artificial
  Synthetic
gaattcaaaatctttggttcaagaagtctctgaacttgtccaaatcgtttaacatcaggaatgaggtaactatccccagcgatgctgatgcagattttgatctgtttgtcaatggtggtactatttctgatgcaaagctggagttgtcaaaaccaactaacttgaatgcttttgatatcatctcactttctgctggattagatctctctgggctatttgatgataaacacaagaggacagaagagcgattcacatcgcagcagccttcctccgctattatatctaaactagaagacattgcgaagaatctaaaactaaaggtgcagaagaaagtgggagggctgttgaaactagaaggagaaacagcgggaaggaagggggttttgtccattgaagccgaaatcttcgaggtgactccatcttttcatttggtagaagttaaaaagtccagcggtgataccttggagtacagagatatattaaaacaggaaataaggcctgcactcaaagacattgtttggacatggcaaggtgagcaacagcaaaagcaagagcaagaacaacaagaattgcagctttcttagatagtcagaattgtttgttcttaccatttcatattaagttaatcaaagttcttatttccctttggc

SEQ ID NO: 7282 - DNA, 993 bp, Artificial
  Synthetic
tgtataacaaaatatctgctgctgaatttacttgcccaccttggatctcttttgctgccatgaagttaattactcgcatcttggatccaaatcctacaacgcgtattaccgcccctgaaattttggaggatgagtggtttaagaaagattatagaccacctgttttcgacgagatagaagatgcaaacctggatgatgttgaagctgttttcaaagactctgaagaatatcatgtaacagagaaaaaagaagagaagccaacttccatgaatgcattcgagttgatttctatgtcacaaggacttaacctcggcaatctcttcgacgaacagggattcaagcgagaaacaaggttcacatctaaatgcccggccagcgagataatcagtaagatcgaagaagcagctaaacctctcggctttgatgttagcaaaaagaactacaagatgaggctccaaaatctgaaagccggaagaaaagggaaccttaatgtttccactgaggtatttcaagttgctccgtctcttcatatggttgaggtgcgcaaggcaaaaggtgacactttggaattccacaagttctacaagaatctttcaacctccttagatgaagttgtatggaaaactgaagagaacatggaaaagaaaaagtgaagagcaatagaagttgcatttttttttaaaaatctctgttgctaccaattgtaagaactgttctttctttactattgtttttctttcatttgtttttcttttttcttttgagaccatcttttctgggaattttttctcttaagagaattaccatagaaggatttctcaaattgtttcactagttataggtgttagacagacagcagagtttggtcctattaaggtgaagtttgtataatctgtgtcacttttcacaaatgtgattgcaattgtatactgtatattggattctttagatttttatttctttgaaaaataattaatagatttttatttagtg

SEQ ID NO: 7283 - DNA, 349 bp, Artificial
  Synthetic
aaactacgttgcccctgaggttttgtcggacaaaggctatgacggtgcagcagcagatgtctggtcttgtggtgtcattctctttgtgcttatggctggttacttgccttttgatgagccgaatctcatgacattatacaaacgtatatgcaaggctgagtttagctgcccaccatggttctcgcaaggtgccaagagagtcatcaagcgtattctcgaacccaaccctattaccagaataagtattgcagagttgctcgaagatgaatggttcaagaaagggtacaagccgccatcatttgaccaagatgacgaggacataaccatagatgatgttgatgctgctttt

SEQ ID NO: 7284 - DNA, 575 bp, Artificial
  Synthetic
tggtatgaacgcagagtggcctttacggccgggggatatgatggtgccaaagctgacatctggtcttgtggggtgatcttatttgtcttgttggctggttatcttccgttccatgactcaaatcttatgaatatgtataggaagataagtagggcggaatacaaatgccctaattggttccctttagaagtgcgtaaacttctttctagtatcctcgacccaaaccctcatacaaggatttcgatagccaaaattaaggaaagctcctggtttaagaaagggttggaatccagacatgtgagaaccaaactagtacagaaccaaaatgttaatgcagatggcgatgctgtttgcagttcgagtttggagaacagcatctcttcctctgacacaaagctagagttggcaaaacctatgaatctaaatgcatttgatatcatctctctttcaagtggttttgacttgtctggtctatttataagaaatgatcaaaaggaggaactgcaattcacatcagtgaagcctgccgcggtcatcatatctaagcttgaggaagttggcaagaatctgaacct

SEQ ID NO: 7285 - DNA, 656 bp, Artificial
  Synthetic
cttgaccattcacagtggaattctgattgtttctctctttcatggaatcagaattattatagtatccattaacatatttattaaccagttaaatatataaggtgctggtcctagttgcttttttttctattaaggtgctcgtcttcaactaagataagtgaaatgtggatgctggctttacaggattcaatgaagcagcatcaaacacgctttcttacgcagaaaccagcaaaagttgttttatcaagtatggaagttgtggcccaatccattggtttcaagacccacatctgcaattttaagatgagggtagaaggtctgtccgcgaacaagacttcacatttctctgtaattctagaggtgtttgaagttgctcctacatttttcatggtagacgttcagaaagcagctggtgatgctggcgaattccttaagttttacaagaacttttgtggcaatctggaggatatcatctggaagccatcagatgaaacatgcaaatcaagggctacaaaaacaaggagtagaaagagatgatattcgtgttaaagaatctgtttgtaattttgtgtttgtatgaagtttacagcatgttgtaaacttttgtagattgacatctaacctttgaagcacgataggctgtgagtactctttat

SEQ ID NO: 7286 - DNA, 640 bp, Artificial
  Synthetic
ggttatcctctggagcaaggcggcttataacccgcatactgaatcctaatccaaaaaatcgtatcaccattcctcaaattcttcaggatccttggtttctgaaaggatatcaacctgccaactttgaggaggctcaagaaatcaatctagatgatgtgaatgctgtttttagctcgtcgaaggagcattttgtcactgaacagaaacaatcaaagccagttcatatgaatgcatttgagcttatttcactctcgaagggactaaacctatcaggcctatttgctaataagcaggaagtgaagagggaggctcgatttacctcccaacatccagcacctgagatcctttcgaaaatggaagaaacagcaaaaccgctcggtttcaatgtgcaaaagcaggatttcaagatgaagcttcagggagctgagagtggtcgtaagggtcatgtttctgtttcaacagaggtgtttgaggtggccccttctctttttgttatagaagttcggaaagcaggcggtgacacactagaatataacaagttttatcaaaacttctctactgggttaaaggatattgtgtggaagacagaagtcgatttggaagggtaaaatattcggaacaatggcagtttaatattgca

SEQ ID NO: 7287 - DNA, 630 bp, Artificial
  Synthetic
cccaaaaaagagagacaagattcacatcacaatgtcctccaaaagaaattatcaccaagattgaagaagctgcaaagccacttggatttgatattcaaaagaaaaattacaagatgcgcatggagaacctgaaagcaggtagaaaaggcaatctcaatgttgcaactgaggttttccaagtagctccatccttacatgtggttgagctcaagaaggcaaagggggacactctggagttccaaaagttctacagaaccctgtcgacccagctcaaggacgtggtctggaagtgcgacggcgaggtcgaaggcaacggcgccgcggcgtgaacgtggtttttgccatggctttcggggcaccggttcttcgtgtacatagctgctctgccatcatcaatggggtgttcgccgtagagtagctttttgtaacaagagaaaaaggaaagaaaaaaagagagggaaagattcgttggttcgttgataggtaggctgctccgatgaaacaacgggcgcgatgcctgctgtggatgagcttgtcgccgtgttagttcatttattctgtggcctcggaaggttgtaacgggacacaatcagatgccgcaatgcaacgggctgacagtttgtgagtttc

SEQ ID NO: 7288 - DNA, 611 bp, Artificial
  Synthetic
cccacgcgtccgcccacgcgtccggtagttctagatcatgtctaaaatagaggaagcttgtggacctcttggtttcaatgtgcggaaacaaaattataagatgaagttaaaaggtgataagactggaagaaaaggccatttatctgtagcaacggaggttttcgaggttgctccatcactccacatggttgagcttcgtaaaactggaggggacacgctggagtttcacaatttctacaacaatttctcgtcagagttaaaagacatagtgtggaaatctgaatctgacgcaaaagcagcaaagaagaggtgatctttagtattctaactatccaacgctcctggatgtagttccctctttgtagcgtttgcaccatttctccaggtgacaccaaaggatatcgtcctcctggtcttgtgcgcattgatgaattttctgggatcacatcttgttgtgccaatccttgtaaaagggtgcgcttcttttttttctttttgacccttagcgcaactgtggacatgctcacatacatgtataaggccctcccggagatgcaccttgtatttgcagttgggatgtcaaataggtgtcctacatgctttggtgacca

SEQ ID NO: 7289 - DNA, 394 bp, Artificial; identical to SEQ ID NO: 5248
  Synthetic

SEQ ID NO: 7290 - DNA, 89 bp, Artificial; identical to SEQ ID NO: 5249
  Synthetic

SEQ ID NO: 7291 - DNA, 1510 bp, Artificial
  Synthetic
tagaatatacacttctcttatcttcacatctccaatccttcaaatctcctccacccaatcctttaatccactagctaccctctctaaaaagatcccaactccccttctccttattttccttattcaccattaccttattatcaattccctcctcttaatattttgttccatttcttgatatctcaaacatggctgctgcagtaagtgctgcagtttctcttccatcgtccaagtccacctcttttcccaccagaacctccatcatctcccctgaaaagatcaactttaacaaggtgcctttgtactacagaaatgtgtcagctggtagtagagtggtttcaatcagagcccaggtgaccacagaggctcctgctaaagttgagaagatttccaagaaacaagatgagggtgtggttgtgaacaagttcaggccaaaggaaccttacattggtagatgtctactcaacactaagatcacgggtgatgatgctcctggtgaaacttggcacatggtcttcagcactgagggagaggtcccatacagagaaggacaatccattggtgtgattgctgatggtgttgatgccaatgggaagcctcacaaactcagattgtactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaggtcaagattactggacctgttgggaaagaaatgctcatgcctaaggatccaaatgccaccattgttatgcttgcaactggaactggaattgctcctttccgttcattcttgtggaagatgttctttgagaaacatgaggattacaagttcaacggtttggcatggcttttcttgggtgttcccaccagcagctcgctactttacaaagaggagttcgagaaaatgaaggagaaggcccccgaaaactttagactggactttgcagtgagcagagagcaaacaaacgaaaaaggcgaaaagatgtacatccaaaccagaatggcacaatatgcagaagaactatggggtctgctacagaaagacaacaccttcgtctacatgtgtggactcaagggcatggagtctggaattgatgacattatgacttcacttgctgctagagatggtattgtatgggcggactacaagaagcaattgaagaaggcagagcaatggaatgtggaagtctactaaatatttttggttttctttgtataaatatgagccaactttatgcttctctacccttcatccatgtagataggtaaatttttccttttaaattaattttcattttttttttggattttccttttcttgaaatttcatcattaaatgaatcagtgtattgacattggccctgtaaaaggaattgacggcatgtatcaataacatatagctgaatcaacctcaattgctgtctgttg

SEQ ID NO: 7292 - DNA, 1293 bp, Artificial
  Synthetic
ttttttttttttcatgtctaatgattgactttcttggtggagttacactgtgtccattaattgacacgattattcagttgcaaaaatggcgaaaaccacagaaagactattaactcaatacacttcaacatgccactgcttgttcttcctgagctgagtaagtttctgctcccagctttcgcctcgctcttcagcgactcttttaagcgtatcttgaatcccgggcatcattcctttaagtccgcaaaagtaaatatgagctccattgtccaaaagtttgaaaatttcatcgctgtattcttcaatcttgtcctgcacatacattttccctcctttcttgtttttctcttctctgctcagcgctttgtcgtacctgaaattttctggatagtccttgcggtacccggcaaattcttcatcataaaaaaaactgtctgagttagccacaccaaggaagagccaagcaagtccgtcaaacttgaaattgggaacattctccataaacatacgccgtaggtatcctctgtacggagcaactccggttccagtagcaatcattatgtgagtagctttcgggtcatcttcaggtaaaagcattacctttccagatggaccggtgattttaactttatcgccgggtttggcattgcacaagaagttactgcatacaccagctttggaaggatcttcttttcctgtctccggatcatagtaaatagctcgacggacacatagactagctgttttgccatcaaaagaatctccataccgtgttgatgcaatcgaataaaggcgaacgttatgaggtgcaccaggtttcttgggattctcaccaggaggaatgactccatagctttgtccttcccagtaaggaacattaccatcatgatcaataacaatgtggcaagtctctccaggtgcttgtggaccaacaattctctcaaccgaaacaatagttgcagtataaggctccttaggcctaaacaagtttaagggagtctctttgggatcttcaagttctagaggagtaaccaagactttggatttgcttgattgctgaagtgacatgcatattgtggacctttttttcacacctaagcttctagatttcgaatctagtctcagcagaggaggaccccatgacttatcagtgaagcttatactttgaaccttaatcatagatcggctcgacccatcaattctagttggaagtgcaacggacatctgagaaggagtagttgagagagccatagcaatggagaaaagagacgataattctcccggacgcgtggg

SEQ ID NO: 7293 - DNA, 675 bp, Artificial
  Synthetic
tccgctgggaaggtaatgctattacccgagagtgatccaaacgcgccccccataatgatagccccgggaacaggagtggctccatacagaggctacttacgtcgaatgttcatggaaaacgtcccaaacaagacatttagcggcttagcttggctcttcttaggcgtggccaacaccgatagccttctctatgacgaagagtttaccaagtacctaaaagaccatccagacaactttaggttcgacaaggcattgagcagagaggagaagaacaagaaaggtggaaagatgtacgtgcaggacaagattgaagaatatagtgatgagatcttcaagcttttggacaatggagctcatatttacttctgtgggcttaaaggaatgatgcctgggattcaagatacacttaagagagttgcagaagagagaggtgagagctgggacttgaagctttctcagctcaggaagaacaagcagtggcacgttgaagtctattgagctctttatttgtatttgctgtttttgatttttgatttaagaatcgtaataaatttgaatttggtgtttttctacttttcaaacatgatatgatgataatatctgaaatttgttggttttgagaagagaatattctcagagaataatcaatatatcatttatgtaaaaaaaaaaaac

SEQ ID NO: 7294 - DNA, 718 bp, Artificial
  Synthetic
gcagcaacttcctatgtgattcaaagcccggtgacaagattcaaatcaccggtccatctgggaaggtaatgctattacccgagagtgatccaaacgcgacacacataatgatagccacgggaacaggagtggctccatacagaggctacttacgtcgaatgttcatggaaaacgtcccaaacaagacatttagcggcttagcttggctcttcttaggcgtggccaacaccgatagccttctctatgacgaagagtttaccaagtacctaaaagaccatccagacaactttaggttcgacaaggcattgagcagagaggagaagaacaagaaaggtggaaagatgtacgtgcaggacaagattgaagaatatagtgatgagatcttcaagcttttggacaatggagctcatatttacttctgtgggcttaaaggaatgatgcctgggattcaagatacacttaagagagttgcagaagagagaggtgagagctgggacttgaagctttctcagctcaggaagaacaagcagtggcacgttgaagtctattgagctctttatttgtatttgctgtttttgatttttgatttaagaatcgtaataaatttgaatttggtgtttttctacttttcaaacatgatatgatgataatatctgaaatttgttggttttgagaagagaatattctcagagaataatcaatatatcatttatgtagt

SEQ ID NO: 7295 - DNA, 1070 bp, Artificial
  Synthetic
cggagacgaccgcagcgccgggtgcggaggtgactactaaggtggagaaggtgtcgaagaagcaggtggatggcgtggtgacgaacaagtacaggcccaaggagccgtacacggggcggtgcctcctgaacacgaggatcaccggcgacgacgcccccggtgagacgtggcacatggtgttcagcaccgacggcgagatcccctaccgcgaggggcagtccatcggcgtcatccccgacggcatcgacaagaacggcaagccccacaagctccgcctctactccatcgccagcagcgccatcggggacttcgccgactccaagacggtatcgctgtgcgtgaagaggctggtgtacaccaacgatcagggagagatcgtcaaaggagtctgctccaacttcctctgtgacctgaagcctggttcggacgtgaagatcacggggccagtggggaaggagatgctgatgcccaaggaccccaacgccaccatcatcatgctgggcaccggcaccggcatcgcgcccttcaggtccttcctgtggaagatgttcttcgaggagcacgacgactacaggttcaacggcctggcgtggctcttcctcggggtgcccaccagcagcacgctgctgtacagggaggagttcgagcggatgaaggagatcgcgccggagaggttccggctggacttcgcggtgagccgggagcagacgaacgcggcgggggagaagatgtacatccagacgcggatggcggagtacaaggacgagctgtgggagctgctcaagaaggacaacacctacgtctacatgtgcggcctcaagggcatggagaaaggcatcgacgacatcatgatcgacctcgctgcaaaagacggcatcgactggcttgactacaagaagcagctgaagaagtcggagcaatggaatgtggaagtctactgatggatatatatatatatatgttaataattaattaatccctttttatctcgatgcatgcgcaacctgcatacgccatcttgctgtactcgatctgatgagatgcatgtaaatattatactgacgattcgt

SEQ ID NO: 7296 - DNA, 626 bp, Artificial
  Synthetic
cccacgcgtccgggccgccggcacggctgcggccgtctccacctccgccgctgctgcagtcaccaaggcatcgccgtcccccgcccactgcttcctgccatgcccgccaagaaccagagccgcccaccagcgcggcctgctgctgcgcgcgcaggtgtccaccaccgacgccgccgccgtcgccgccgcgccggccaagaaggagaagatatccaagaagcaggacgagggcgtcgtcaccaacaagtacaggcccaaggagccctacgtcggcaagtgcctcctcaacaccaagatcaccgccgacgacgcgcccggcgagacatggcacatggtcttcagcaccgagggtgagatcccctacagagaggggcagtccatcggcgtcatcgccgacggcgtcgacaagaacggcaagccgcacaagctcaggctctactccatcgccagcagcgctctcggcgacttcggcgactccaagaccgtttcactctgcgtcaagaggctcgtttacaccaacgaccagggagagattgtcaaaggagtctgctccaacttcctctgtgacttgaagcctggttctgatgtcaagataaccggaccagtaggcaaagaaatgctcatgc

SEQ ID NO: 7297 - DNA, 599 bp, Artificial
  Synthetic
cggacgcgtgggcggacgcgggggtggggactcttttgatgggaaaacggccagcttgtgtatcaggcgagctgtctactatgatcctgagacaggaaaagaagacccttccaaaaatggtgtttgcagcaactttctgtgcgactcaaagcctggtgacaaagtgaagatcacaggtccttctggtaagataatgcttctaccagaagataatccaaatgccacacacatcatgataggaactggaactggtgtggctcccttccgaggctaccttcgtcgtatgttcatggaatcggttccaactaagtttaatggccttgcttggcttttccttggggttgcaaacactgacagccttctatatgacgatgagttcaccaagtatctcaatgactacccaggcaatttcagatatgaccgtgctcttagccgtgaacaaaagaacaataaaggggggaagatgtatgtccaggataaaatcgaggaatacagtgatgagatcttcaaactactggatgaaggggcccacatctatttctgtgggttgaaggggatgatgcctggaatccaagataccctgaacagggttgctgacg

SEQ ID NO: 7298 - DNA, 601 bp, Artificial
  Synthetic
tacaagttcaatggtctggcttggctcttcttgggagtcccaactagcagttctttactctacaaggaggagtttgacaaaatgaaggcgaaagcgccagagaacttccgggtcgattatgctgtgagcagggagcagaccaatgctcaaggagagaagatgtacattcagaccaggatggcagagtacaaggaagagctgtgggagctcctgaagaaggacaacacctatgtgtacatgtgtggactgaaaggcatggagaagggtattgatgacattatggtgtcattggctgcaaaagatggaatcgactgggctgattacaagaagcaactgaagaagggcgagcaatggaacgtggaagtctactaattcttccaattttcctcacatctgtttcttttttttcttccatttgtatctgtgtgcacatctgtgcctgtgatcactctataatgttagataggcgtatatatatatatactctttgtcatgttggttaaattcaagcttcatataagaattactacttatgtctgatccaaatactactatggtcaagtcaagagtaataataataataatgcaatgcagttcactc

SEQ ID NO: 7299 - DNA, 611 bp, Artificial
  Synthetic
ccgcggacgcgtgggatgctgggcaccggcaccggcatcgcgcccttcaggtccttcctgtggaagatgttcttcgaggagcacgacgactacaagttcaacggcctggcgtggctcttcctcggggtgcccaccagcagcacgctgctgtacaggaaggagttcgagcggatgaaggagatcgcgccggagaggttccggctggacttcgcggtgagccgggagcagacgaacgcggcgggggagaagatgtacatccagacgcggatggcggagtacaaggacgagctgtgggagctgctcaagaaggacaacacctacgtctacatgtgcggcctcaagggcatggagaaaggcatcgacgacatcatgatcgacctcgctgcaaaagacggcatcgactggcttgactacaagaagcagctgaagaagtcggagcaatggaatgtggaagtctactgatggatatatatatgttaataattaattaatccctttttatctcgattttcatgcatgcatgcgcaacctgcatacgccatcttgttgtactcgatctgatctcatctgatgagatgcatgtagatattatactgacgattcgtcgacta

SEQ ID NO: 7300 - DNA, 923 bp, Artificial
  Synthetic
agcggcggagaaggcgctgcggcggcagcggcagcggtggtgcgtggagcgccggatttgtcgcgtgaatcgaggtagcactacgcaatgagtcgatccagtcggacaatttatgtcgggaaccttcccggtgatgttcgggagcgcgaaatcgaggacttgtttcacaagtatggacatattgtagacatcgacttgaagctgccaccgaggcctccggggtactgtttcatcgaattcgaggacgctcgagatgccgaggacgccattcggggtcgtgatggctacaactttgatggataccgtctacgtgttgaaattgctcacggtggccgcggccctccgtcctcggatcgatacagtagccatggtggtcggggcggaagcgtttccaggcgttcggaatacagagttatcatcacgggcttgccttcgtcggcgtcttggcaggacttaaaggaccatatgcgacgagctggcgatgtttgcttcgcccaagttttccgagagggaaacggaactacaggcattgttgacttcaccaattatgacgacatgaaatatgcgattaaaaagcttgacgattcggaattccgtaatccattctcgcgatcgttcatccgcgtcaaggaagacaggtctcagggattcacacgaaacctttcgcgcattgtcagtcgaagccggagcaaaagtcgtacccgcacttacagccgtagcaaaatccgcagtcgaagtcggagccgtgggcgatctaagagtccaggatgcaggtccaagtcatgctcgaagtcggattcgaagtctcctgtggctcgatcgacgtctcggtcgtactcgccgcgctcaccggggtctcctgttgttaaggaatcaagccgaatgccgactccccgtcgctcccgctcagattctcctgcggc

SEQ ID NO: 7301 - DNA, 288 bp, Artificial
  Synthetic
aattgcggaggctgagagatctcaaatcgacgaccaacaggaagaatgagcagtcgttcgagtagaaccgtgtacgtcggaaaccttcctggcgatatccgtgagagagaggtcgaagatttgttcagtaagtatggacctgttgttcaaattgatttgaaggttcctccaaggcctcctggttatgcattcgttgagtttgatgatgctcgggatgctgaagatgctattcatggtcgtgatggctatgactttgatgggcatcgtttgagggtggaattggcgcat

SEQ ID NO: 7302 - DNA, 665 bp, Artificial
  Synthetic
tgcttacaggcgttagaagagaagacggagagagagagagagaagggaagtccaggcgtctctatctttcttactctgcccttctcagcattcccactgccatgtccacccctgcacggaagcgcttgatgcgtgacttcaagcggcttcaccatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaattccgaagcagcacgaatgtatagcgaaaaccggcgagactacaaccggaaagtgcgcgaaatagtggagcaaagctggacggctgaatgatggatgaactgtctacctctagtgatatacaagtgtgtcgaaacagttgcatgaggttgaactaattctctccttttacaagtttggcactttcgtaaaaattct

SEQ ID NO: 7303 - DNA, 510 bp, Artificial; identical to SEQ ID NO: 4479
  Synthetic

SEQ ID NO: 7304 - DNA, 758 bp, Artificial; identical to SEQ ID NO: 4481
  Synthetic

SEQ ID NO: 7305 - DNA, 748 bp, Artificial; identical to SEQ ID NO: 4473
  Synthetic

SEQ ID NO: 7306 - DNA, 651 bp, Artificial
  Synthetic
tactgtcaaatcagatctcttcaatttgctagggttttggtttcttctccctctctgatggcttcgaaacggatattgaaggagcttaaggatctccagaaagatcctcctacctcttgcagtgccggccccgttggagaggacatgtttcactggcaagctacaataatgggccctccagatagcccctacaccgggggtgtatttttagtcactatccattttcctcctgattatccatttaaacctcctaaggttgcttttaggacaaaagttttgcatccaaatattaatagcaatggtagtatatgcttggacatattgaaggagcaatggagccctgccttgactatttctaaggttttgctttcaatatgctcacttttgacggatccaaatcctgatgaccccttggtgcctgagattgctcatatgtacaagaccgacagggcaaaatacgaaacaactgcccggagttggacccagaagtatgccatgggttaaaccgttacctatggcacttgaatttatgtaaaaagaaagattgcatctgtcctctactttccatacaagaagtgtagaatagcattgaacaatgcctgtggaggaatgctgatgtgttgaatttgtttatatatatactaatatttg

SEQ ID NO: 7307 - DNA, 846 bp, Artificial; identical to SEQ ID NO: 4475
  Synthetic

SEQ ID NO: 7308 - DNA, 761 bp, Artificial; identical to SEQ ID NO: 4531
  Synthetic

SEQ ID NO: 7309 - DNA, 783 bp, Artificial; identical to SEQ ID NO: 4532
  Synthetic

SEQ ID NO: 7310 - DNA, 546 bp, Artificial; identical to SEQ ID NO: 4542
  Synthetic

SEQ ID NO: 7311 - DNA, 342 bp, Artificial
  Synthetic
cccacgcgtccgacgagaagaaaaaggcgaaaacctcgccaatccgattacgcgaaaaatcaaaggtttttggatatggcgtcgaagcggatcttgaaggaattgaaggatctccagaaggatccacctacatcatgtagcgcaggtcctgttgctgaagacatgtttcactggcaggcaacgataatgggtccttcagagagtccttatgctggaggtgttttccttgtaaccatccatttccctccggattacccattcaagcctcctaaggtggcctttaggaccaaggtgttccatcccaacattaacagcaacggtagcatttgcctcgacatcttg

SEQ ID NO: 7312 - DNA, 618 bp, Artificial
  Synthetic
ccccccgaacggctgcgcgtcttcccgttcgtcctcctgtccggtccgagcccctctgacgacgcgactttccccacgccgggatcgagctccggggaggggagctgcgagctgaaacactttgtcatatcagtcaacagtagagaggagaccagatgcaggcatctagagctaggctctttaaggagtataaggaggtgcagcgagaaaagtcagctgatccagatatccagttaatctgcgatgattcaaacatattcaagtggactgctcttatcaagggcccttcggagacaccttttgaaggtggtgtatttcaacttgcattctctattcctgagcaataccctctccttcctccgcaagttcgcttcttgaccaaaattttccacccgaatgtgcatttcaagacaggtgagatttgcctggatatcttgaagaatgcgtggagcccagcatggacactacaatccgtttgtagagccataattgcattgatggcccatcctgaaccagacagtccacttaactgtgactcaggcaacctcctgcgctcaggcgacatcagaggctatcaatccatggcaagaatgtatactaggttggctgccatgccaa

SEQ ID NO: 7313 - DNA, 483 bp, Artificial; identical to SEQ ID NO: 4521
  Synthetic

SEQ ID NO: 7314 - DNA, 615 bp, Artificial
  Synthetic
atcgagtaggaggatctctgagggatatggcatccaagagaattctgaaagagctcaaggatctgcagaaagatcctcccacctcttgtagcgctggcccagttgctgaagatatgtttcactggcaagcaacacttatgggtccatctgacagtccttatgctggcggagtgtttcttgttaccattcattttccacctgattatccatttaagcctccaaaggtagcttttaggacaaaagtttttcacccaaacatcaacagcaatggtagcatttgcctcgacattttgaaggaacagtggagcccggcactcacaatatctaaggtgttgctgtccatctgttctcttctaacagacccaaatcctgatgatcctttggtgcctgagattgctcatatgtacaagactgataaaagcaagtacgaagccactgctcggagctggactcaaaaatatgccatgggttagttgctgaaacacaaatatttggcttttatctatgatgtattaagaaattgtgttatgcataattaactcaagggaaaggttgaattgtggccctctgtaaaacacttaattttcctcatgtttgtaagattaaatggttttg

SEQ ID NO: 7315 - DNA, 647 bp, Artificial
  Synthetic
ccccttttggctaccctacaaccttcttgagacccctttaaattcctcactttctctctctagaatctctctctttttctctctctatctctctctgaagtcgtatggcttcaggttctccttcacaagccagtcttctccttcagaaacaactcaaagatctcaatagaaacccagttgatggattttcagcaggtttagttgatgaaaataacttatttgaatggagtgttacaattattggcccccaagatactctatatgaagggggtttctttaatgctatcatgagttttcctcaaaattatcccaacagtcctccaactgtgagatttaccacagatatctggcatcctaatgtttactccgacggaaaagtttgcatctcaattcttcacccgcccggtgatgatccaaatggctatgagcttgccagtgaacgttggtctcctgtccacacggtagagagtatagttttaagcatcatatccatgctttcgagccctaacgatgagtctcctgctaacgttgaagctgctaaggaatggagggaaaaaagagatgaattcaagaaaagggtcagtcgttgtgtaagacggtcacaagaaatgtagtaaacatgcatgccaacctgcatttctgcgatt

SEQ ID NO: 7316 - DNA, 666 bp, Artificial; identical to SEQ ID NO: 4535
  Synthetic

SEQ ID NO: 7317 - DNA, 711 bp, Artificial; identical to SEQ ID NO: 4536
  Synthetic

SEQ ID NO: 7318 - DNA, 664 bp, Artificial
  Synthetic
agaaatcaaatcgaccccttactcctctaaatccccacacccatctctctctctctctctctcctcaatcgaaggatccgacaataaaagttgattgtcttcaacatctgtctaccagcaaaaactacttgcgtgcagtcgccaactgatcctaggattatacttacatttggctatggcaactaatgaaaatctcccaccaaacgtgataaaacaattggcaaaggaattgaaaaatcttgatgaaactcctcctgaaggcatcaaagtaggtgtcaacgatgatgatttttcaaccatatatgctgatatcgaggggccagctgggactccttacgagaatggggttttccgcatgaagttgattttgacgcatgatttccctcattccccacctaaaggttattttctgaccaagatttttcatcccaacatcgcttccattggcgaaatttgtgtcaatgctctgaaaaaagattggaatcctagtttgggcctacgacatgttctcatggtggtaaggtgtttgctgatcgagccatttccagaatctgcgttaaatgagcaagctggtaaaatgctgcttgataattatgatgagtatgctagacatgcaaggctttataccagtattcatgctaaaccaaagactaagttaaaaaca

SEQ ID NO: 7319 - DNA, 584 bp, Artificial; identical to SEQ ID NO: 4538
  Synthetic

SEQ ID NO: 7320 - DNA, 636 bp, Artificial; identical to SEQ ID NO: 4539
  Synthetic

SEQ ID NO: 7321 - DNA, 634 bp, Artificial
  Synthetic
ggcctctctctctctctctctctccgtttgagaagaactgtggtgggtggggggccataataataagaagaggtattattattattattattattattagtattataatgagcttgcagagaggagggcaggagggtagcttggctatggcggatggaaagcactctggtgcccccgttgatacacattccgtcgctcgtagattgcagtcggagctcatggcattgatgacctgtgggggggacccaggtgtatctgcttttcctgacggagacaacatcttctcttggcttggaaccatcaaaggaagcaccgcaactgtctatgagggtctctcgttcaagctttctttgcgctttccaaatgagtaccctttcaagcctcccactgtgaaattcgataccccttgcttccaccccaacgttgatcagtatggcaacatttgccttgacatcttgcaggataagtggtcatctgcttatgacgtccgcaccattctcttgtctattcaaagtctacttggagagcccaataatgctagtccattgaacagttatgcggcaactctatggtgcaatcaagaagagttcaagaaggcgatgcaaaaacatcacaaagatgctactggacttac

SEQ ID NO: 7322 - DNA, 685 bp, Artificial
  Synthetic
actctttcttggctctctacaaattgtcttctctctctctctctctctctctcgttcctttcgtttctttgccttccctataacggcggtggctatttaagaactccaagtagcagaagttatagttgaagagggatctggatctgaatctgaatctgtgtcatggctagcaagaggattttaaaggaactcaaggatctgcaaagggatcccccaacctcatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgca

SEQ ID NO: 7323 - DNA, 250 bp, Artificial; identical to SEQ ID NO: 4495
  Synthetic

SEQ ID NO: 7324 - DNA, 428 bp, Artificial; identical to SEQ ID NO: 4489
  Synthetic

SEQ ID NO: 7325 - DNA, 522 bp, Artificial; identical to SEQ ID NO: 4487
  Synthetic

SEQ ID NO: 7326 - DNA, 500 bp, Artificial
  Synthetic
ttttaaatcgtaatacatatatacacaaaagtgaataattgagatggtttggtacaaagttgtttttttaaggatgttgggttacatcaaagcatggaatcacttaaatagttttggaaacacaagacatgaatgaaaagagaagaaagctgttgctgaatcgtgattgagagaaagtagagagagctacaacgcttacaacaaactactactagtcagcagtccagctttgctcaacaacatcacgcactctcctgttgtactcgcgcttgctttcgctgtacatccgagcagcttccgagtttgcaggagaattcggattagggtcacagagcaaggactggatggaggtaagtatagcagcaacatcatagattggactccactggttttgtagaatgtccaagcagatactcccatctgcataaatattaggatgaaacatccgtgacacaaaccgaactgttggtggtttattgggataatcttcagagaactgc

SEQ ID NO: 7327 - DNA, 343 bp, Artificial; identical to SEQ ID NO: 4485
  Synthetic

SEQ ID NO: 7328 - DNA, 377 bp, Artificial
  Synthetic
cgctttcaccacaagaagaaacaacagaagatgatcagattctagttttcacaaagatgatgtttttttgtttcgtttaaaacaagacccacttcatttggtcctgtcttcagaaagttaaaaggacacaaagagatgtctatcgaatcatacatagaaattaaggcagatttttttcttcataaagagataatttagtaggtgggattttccatttagcccatggcatacttctgagtccagcttcgtgcagtggactcgtacttgttcttgtcagtcttgtacatgtgagctatctcgggcaccaaaggatcatccgggtttggatcggttaacaaagaacagatcgatagcagcaccttggaaatggtgagcgc

SEQ ID NO: 7329 - DNA, 541 bp, Artificial; identical to SEQ ID NO: 4488
  Synthetic

SEQ ID NO: 7330 - DNA, 596 bp, Artificial
  Synthetic
cccacgcgtccgggatattgaaagaattgaaggagttgcaaagagaccctcctgtatcatgcagtgcaggtccaacaggagaagatatgttccactggcaagctactataatgggtccgaatgaaagtccttactccggaggtgttttccttgtcaatattcatttccctcctgattatccttttaaacctcccaaggttgtattcagaaccaaagtgtttcacgcaaacatcaacagtaatggaaacatatgtttggacattctcaaagaccaatggagccctgcccttaccatttctaaggtttgaaattctatatatgtatttagttatttgtcaatattttctataattccatatatcagatttggtatataaccaagaagctccaataggtaacacaaattactaacattttggtattataggtgcttctctctatatgctctcttctaacagatccaaaccctgacgaccctctggtgccagagatagctcacatatacaaaactgacaagaccaaatatgaagccatggctcgaagctggacccagaagtatgccttgttttaaagctcacaattcctctttttttcct

SEQ ID NO: 7331 - DNA, 409 bp, Artificial
  Synthetic
cccccacaccctccccgactcctcgcagggtcctcttgtttttcttggccgaaccccccctcgacacgccgtcgccgccgaggggagagagagagaggccgccggccgccgctaccactgaccccccccctcgccggagcgccccgtcgccgggtttgatcgatggcgtccaagaggatcctgaaggagttgaaggacctgcagaaggaccctcccacctcatgcagcgcaggtcctgtgggtgaggacatgttccattggcaagctactattatgggaccctcagacagcccatttgctggtggggtattcttggcgaacattcatttcccaccggattatccttttaaaccaccgaaggtctctttccgcaccaaggttttccacccgaacattaatagcaatggca

SEQ ID NO: 7332 - DNA, 597 bp, Artificial
  Synthetic
cccacgcgtccgcccacgcgtccgctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagcagccagactgttcagcgagaacaagcg

SEQ ID NO: 7333 - DNA, 653 bp, Artificial; identical to SEQ ID NO: 4506
  Synthetic

SEQ ID NO: 7334 - DNA, 621 bp, Artificial; identical to SEQ ID NO: 4507
  Synthetic

SEQ ID NO: 7335 - DNA, 625 bp, Artificial; identical to SEQ ID NO: 4496
  Synthetic

SEQ ID NO: 7336 - DNA, 692 bp, Artificial; identical to SEQ ID NO: 4497
  Synthetic
  misc_feature (413)..(413): The residue at this position can be any nucleotide.

SEQ ID NO: 7337 - DNA, 467 bp, Artificial; identical to SEQ ID NO: 4730
  Synthetic

SEQ ID NO: 7338 - DNA, 876 bp, Artificial; identical to SEQ ID NO: 4500
  Synthetic

SEQ ID NO: 7339 - DNA, 705 bp, Artificial; identical to SEQ ID NO: 4503
  Synthetic

SEQ ID NO: 7340 - DNA, 668 bp, Artificial; identical to SEQ ID NO: 4504
  Synthetic

SEQ ID NO: 7341 - DNA, 604 bp, Artificial
  Synthetic
atagggcgccgcatcgactcgccgcctacgccgccgctatggccgtgaccctgggtttgtagggattttccatccagatttcgaggagatcgctgcgcgtttctcgttcatggctgagaacttacccccaaaggtgattcgagcgcttgcaaaggagctcaagagcttggacgagagccctccagaggacattcgcgttcatgtaaatgacgacaacttctcgagcattttcgcggacattgagggaccacccggaacaccgtacgaaagtggcgtcttccggatcaggcttttgcttagtcccgatttcccgcaaacgccaccgaaaggttatttcgtcaccaagatcttccatccaaacatcgcaaagaatggagagatttgcgtgaacgttttgaagaaggattggaagccgacgctcggcctgaggcatgttcttcttgtcgtacggtgcttgctcatagagccgtttccagaatcggcacttaacgaggacgctggaaagatgttgatggaggattacgatggatacgcaaagcacgccagattgatgacaaacatccacgcgatgaagccaaagccaaagaccacgaaagtcgccata

SEQ ID NO: 7342 - DNA, 557 bp, Artificial; identical to SEQ ID NO: 4508
  Synthetic

SEQ ID NO: 7343 - DNA, 764 bp, Artificial; identical to SEQ ID NO: 4512
  Synthetic

SEQ ID NO: 7344 - DNA, 625 bp, Artificial
  Synthetic
aacaatccccagcctcaccaaaaaggacacaaaataacgacattcactctctctctctctctctcttcctcttttctccattctctcgcggggtcatccgcccaccatggcccaatccaccgcccaccgccgcctccttcaagaataccgcgccctcacaaacaacccgcccgaaggcatcaccgccggccccgtctccgaggacgacctgctgcactgggaatgcctcatccaggggcctgagggaactccctttgagggcggcgtctttcccgcagagctcaagtttcccaaggactatccgctggcgccgccgacgatgaagtttctcgctgacatgtggcatccgaacgtctaccccagcggcctcgtctgcatctccatcctccaccctcccggcgacgaccccaaccactacgagcacgcctccgagcgctggtcccccatccagtccgtcgaaaagatcctcatctctgttatgagcatgctagctgagcccaacgacgagagccccgccaacgtcgaggccgccaagatgtggcgcgagcgtcgggatgagtacgaaaagacggtccgcgacggtgttcggcgcatgttgggtttgtaacagcgcatgttgggtttg

SEQ ID NO: 7345 - DNA, 600 bp, Artificial
  Synthetic
gcagcatgtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaa

SEQ ID NO: 7346 - DNA, 621 bp, Artificial
  Synthetic
ccccggtggagatttttgacgtcgtgaatagatcggattaattggtagcgatcgtcggcggcgagggataaggatggggagggtgaagctgccgatcaagaggatcgagaacacgacgaacaggcaggtgacgttctcgaagcggcggaacgggctgatcaagaaggcgtacgagctgtccgtgctctgcgacatcgacgtcgccctcctcatgttctccccctccggccgcctcagccacttctccggccgccgcggggtagaggacgtgattctccggtacatgaacctctcggagcacgacaggggagaagccatccagaatcgggagtatctcatcagcatgcttcagcggctcaagcgagagagcgacatggcgacacaattagcaaacccaggtgccctgaatgagaaaatagaggagattcagcaagagatatattcttcccagcaacagctgcaaatcaccgaggaccgccttaggatgttcgagccagatcctgcggcgttcggcacatccagcgaggtcgacggatgcgagaagtatctcatggaattgctgacccgagtcgtcgaaaggaagaacaacttgttgagcagtcacatggcgccgttcgatgc

SEQ ID NO: 7347 - DNA, 673 bp, Artificial; identical to SEQ ID NO: 5251
  Synthetic
  misc_feature (577)..(577): The residue at this position can be any nucleotide.

SEQ ID NO: 7348 - DNA, 369 bp, Artificial
  Synthetic
ggggcgacgccgaagctccaatggcattcagtggcggcgcgagagattgatcgatcgtagtggagatgaccgacctggtgagcatacaggcgggggagctgatatttccattcgagctcaataagcaaatctcgtgttccttgaggctcgtcaacaacacggatgaagccatagctttcaaagtaaagactacttcgccgaataactactgtgtgcgccccaacacgggcattatctcgccgcaaggatgcacggatgtcacagtgacaatgcaagcacagaacgaagcgccgctcgacatgcaatgcaaggataagttcttggtgcaaacgctcgtggtttcgacagagacaaccagagacgttactg

SEQ ID NO: 7349 - DNA, 555 bp, Artificial
  Synthetic
tttctctttacctcgagatcctcgccactaaacaacttcccaatcccacctccgttgccggaaaccgtccaaatccgtccttaaaatagaatctccggctgatacctaaaatattatatagagaagatcgctgtcgaaatgagtaacggagagctacttcaaatcgaacctattgagcttcagtttcccttcgaattgaagaagcagatctcatgctcattgcaattgaccaacaaatccgataactatgttgccttcaaggtgaagacgacgaatccaaagaagtactgtgtaaggcctaacactggaattgtgatgcctcactctacctgtgatgtcacagttacaatgcaagcacaaaaagaggcaccaccagacatgcaatgcaaggataagttcctgcttcaaagtgtcgtggcaggccctggaactacgcccaaggatattactccagaaatgttcaacaaggagtcagggaatcatgttgacgagtgcaagttgagagtggcttatgttccacctcaaccaccatcacctgtgcgggaagggtctgag

SEQ ID NO: 7350 - DNA, 719 bp, Artificial
  Synthetic
ccaaagtctgtaatcactaaagcaaagaacaaagaaatcaaatttcctttttctgattcactttctgaaccaaaaaaaagaagaaaaaacgaaaaagagaactgaaaatgagcagtgcagaacaagaacttctcaacatcgatcctcttgagctcaaattcccatttgagctgaagaaacagatatcttgttcccttcaattatcaaataaaactgaaaatcatgttgcttttaaggtcaaaactaccaaccccaaaaaatattgtgttcgtccaaacactggcattgttttgccaagatccacttgtgatgtcattgttacaatgcaagcgcagaaggaggcaccggctgacatgcaatgcaaggacaagtttctacttcagagtgtggttgcaactgccggtacctctccaaaagacatcacccaagaaatgttcaataaggagcctggacgcgttgtggaagagtgcaaattgaaagtgatttatcttcccccaccgcaaccaccatctcccgttgcagaaggatcagaagaaggttcttcgccaggacagtccttgacagagaatgacagtcaaaatggttctgagctgacaagaacattccttgaaactcatgacaaatcttcagaggtgaaatcagttatttatagactgacggaggagaaagctgcttttgtacatcacagcaacagacttcgtcaagaattggaacttctg

SEQ ID NO: 7351 - DNA, 697 bp, Artificial; identical to SEQ ID NO: 5257
  Synthetic

SEQ ID NO: 7352 - DNA, 284 bp, Artificial
  Synthetic
ctgcttcaggatggtccgccacctttggtttcgcaccggtccgatatgcccgccggatatccaatacgggtcctagtgcaatggccatgttccttgccgtttctggtccctttgcttggggaatgtaccaggtcggccagggaaacaaaatccgcagggcattgaaggaagagaaatatgctgctcgtagaacaatacttcccattcttcaagcagaagaagatgaaaggtttgtgtctgagtggaaaaagtatctggaatatgaggctgatgtaatgaaagat

SEQ ID NO: 7353 - DNA, 595 bp, Artificial; identical to SEQ ID NO: 5258
  Synthetic

SEQ ID NO: 7354 - DNA, 679 bp, Artificial
  Synthetic
cggacgcgtgggcgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaaccgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaatgctgccaaactagcactaccttagacctacctgtcttgtttctctgctgcttagaatctcggttccgattgccatgcgtgtaacggacatccaactggtttagtgtatctgggtcttttatatgtgcgcggatgctatggatctttctcatgtaagaggtgtgtaactcgccagttttgcttcaaccacatgaaatttggtattggaa

SEQ ID NO: 7355 - DNA, 551 bp, Artificial
  Synthetic
actttcccggcctcatcactttgccgatacgaagatcgtcccctttcaatccaattataacgatccgttcgagtcgtgaagccgttcaaaatgtcttaccagaagaacgacaaggatgttcaggagccggctaagagccacaagatccgcatcaccctttcttctcgcaaggtccaggtcctcgagaaggtctgctccgagatcatcgaccgtgccaagaacaaggacctccgcgccaagggccctgtccgtctgcctaccaagtgcctgaccgtcactccccgcaagaccccttgcggtgagggttccaagacctgggaccgcttcgagatgcgcattcacaagcgtctcatcgacctccacgcccccactgaggtcgtcaagcagatcattgtcaacatcgacgctggtgtcgaggttgaggtcaccatcgctgcttaagcgaatctccaatttcgtaaagatgttggagtggccgagaccctgacgtcgagggagatgaaaacagccctcgcagcagataagcacaaaataaactggttcaagacata

SEQ ID NO: 7356 - DNA, 414 bp, Artificial
  Synthetic
gccaaaatgtcattcaacaaggataaggccgacgctgaagctccccagcagctccgaaagatcagaatcactctgacttccaccaagatgaagtctcttgagaacgtctccgctgacatcatctctcgagctaagaactccaacgttggcgtcaagggccccgtccgactccccaccaaggttcttaacatcaccacccgaaagacccctaacggtgagggttccaagacctgggatcactttgagatgcgaatccacaagcgactcatcgatctccactcccctgctgaggttgtcaagaagatcacctctatcaacatcgagcctggtgtggatgttgaggtcaccattgccgcttaagcttgttgaccccaaaacttggtataaaaaattgcacatgtattattgatgtct

SEQ ID NO: 7357 - DNA, 286 bp, Artificial
  Synthetic
acacacataaatttagatcaatatggaggattgggctaagaagagactccttccttccttgcagcaaaaagcaatccgccgtcgagcttcgttcgtctctcagaagaagctgcaaatatggcgacagcgtatcaaccaatgaaaccagggaaggctggtttggaagagccactctagcagattcacaagatcagaattactctctcctccaagaatgtcaagaacttggaaaaagtgtgtactgatttggttcgtggagctaaggacaagagactgagagttaagg

SEQ ID NO: 7358 - DNA, 770 bp, Artificial
  Synthetic
cgtcgagctaaggtctccggtccgaaattttggttcgatggggattaaagtcattgttcaaagattcgagtttccgtcaaagtccggacatatttgtttttcgttcgagttcatcgttgttctgatccggtacacagctggtagaccttgtaagttgataacatgaagcatgaatacgaagttgaagcggcagcagttttcagtctcagttgcataattctgagcttcttctctccactctctgaaagatggcagcatatgcagcaatgaagccgaccaagccaggtctagaggagccacaggagcagattcacaagattaggatcactctttcctccaaaaatgttaagaatctcgagaaagtgtgtgctgatttggttcgtggtgccaaggataagaggctcagggtgaagggacccgtgaggatgcccacaaaggtccttaacattaccactagaaagtctccttgtggtgaaggtacaaatacatgggacagattcgagctgcgtgtccacaagcgagtcattgaccttttcagctctgcagatgttgtcaaacaaatcacctcaatcaccattgaacctggtgttgaggttgaggtcactattgctgattcttagatcctttgtcttacctaggtagatgagttactctttatatgctgtcgtattttgccctccagactttatgtattacgagttttttggaattacaattttgctgttaaactaagacttttgataaaagtaaagtgtatggtttgtttattt

SEQ ID NO: 7359 - DNA, 619 bp, Artificial
  Synthetic
aagaaaaccgaagctgcggctacgtcttttacatcttcgtcgcatctccctcagcaaatcaaatcaaatcaaaatatggcgtatgcagcaatgaaggcaacaaaaccagggctagaggagccccaggagcagattcacaagattagaatcactctttcttccaaaaacgttaagaatcttgagaaagtgtgtgctgatctggttcgtggtgccaaggacaagaggctcagggtaaaaggacctgtgcgaatgcccactaaggttctcaacattaccactagaaagtctccctgtggagaaggcacaaatacatgggacaggtttgagctgcgggtgcacaaacgtgtgattgaccttttcagttccgcagatgttgtcaagcagatcacctcaatcaccattgaaccgggtgttgaggttgaggtcaccattgctgattcttagattcttctctgttttcattaggttgttgaatttttttcaagtactagtggtttgcagttgctttcttggccgtctaaattatgggcttaaggttttctttattccaattaaagttttgcagctaaaccagatactaatactatttgatattgggaagaggatttgtccgttaaaa

SEQ ID NO: 7360 - DNA, 634 bp, Artificial
  Synthetic
ttgcgggtgtcaacaagcttctgcgcaccttgtctccttcgatcaccctcaaggtaggagataaaacatggcgatggcaatgggtatgaagcccggaaagcctggcctcgaggagcctcaagaagccctccatcgcatccgtatcaccctttcttccaagagtgtcaaaaacctcgaaaaagtgtgtgcggatttggttcgaggtgccaaagaaaaaaagttgaaggtcaaggggcctgttagaatgcccacaaaggtgttgcgccacaccaccaggaagtccccttgtggagaaggtaccaacacgtgggattgttttgagctgaggatacacaagagaatcattgatttgcacagctcttcagaagttgtgaagcagatcacctcgattacaatcgagcctggagtcgaggtggaagtgacaattgcagatgtctgagtgtagtcaattatttctttttgaccgggaaaaggttattgacttggttgaagagggatgactggtctttcaattttaggttatgtttctccttatgaatatttgttaggatttttgacatttaatcctgtgttaacggagaattgagctggatagtattttggaatcatttcttagcaacccatattaccttta

SEQ ID NO: 7361 - DNA, 713 bp, Artificial
  Synthetic
cgaaaaaccctaacgccacccgcgccgccatccccgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaatcgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaatgctgccaaactagcactaccttagacctacctgtcttgtttctctgctgcttagaatctcggttccgattgccatgcgtgtaacggacatccaactggtttagtgtatctgggtcttttatatgtgcgcggatgctatggatctttctcatgtaagaggtgtgtaactcgccagttttgcttcaaccacatgaaatttggtattggattcaatttttgtc

SEQ ID NO: 7362 - DNA, 320 bp, Artificial
  Synthetic
tggtatcaacgcagagtggccatctgcattgtctacatgcatagtactgtccagaaggaggataacaaccccggattaaccatcttgaggtggatctacgaagagcttccttctgaccataaggacaggcttcaggttgtatactttgtgcatcctgggatacggtcaaggcttgttcttgcaacactaggcagatttttcctgagtggaggcttgtattggaaaataaagtatgtcagtcgcctgcaatatctttgggatgacataaagaaaggagagctccagattcctgaatttgttcaaaagcatgatgacattct

SEQ ID NO: 7363 - DNA, 716 bp, Artificial
  Synthetic
gaaaaactatagacaaactccaaatcttcaagattcaaggtaaagataaacgtggctgcaccatccttcgcatcatcggcaagcttttccctgcaagaattgtaagtgtggaggcagtaaacaagtatctacaagagaagatttatccaagtttagagcagagacaattctcaatagtgtacgtacatacaggagttaacagaagcgaaaatttcccaggaatagtagctctccgatcgatctgtgatgctatgccggaaaatgtgagagatcatctgaaagctgtttatttccttcacccaagcctacagtctcgactctttcttgccatttttggtcgtctcactttcaccggagggatttattggaagctgaattatgtaactaggttagagttcttgtgggaacacgtaaagagaaaggagatagaaatgccagagttcgtgtatgaatttgaagaagagctggatgactaccgtccgatgacggattatggaatggagggagatcatccaagggtttatattgattctactgttgaacctgcagtttcaatgtactcaatgaggtgtattgcttagtagtaaaagaagaaaaactgttttaggtggccttggatgggctggactgatatgtgtgccggcctcttaggtcactttgttttatcttcaagtgttactacttttagaatgtctgcgaaatgcttagttggtatc

SEQ ID NO: 7364 - DNA, 374 bp, Artificial
  Synthetic
gaggatgcaaggatagcgattcaatttggttctttcggaatcattgtatcaaaccatggagctcgccagcttgactatgtcccagcaaccatctcggcccttgaagaggttgtcaaagcgacacaaggacgaattcctgtcttcttggatggaggtgttcgacgtggcactgatgtcttcaaagcacttgcacttggagcctccgggatatttattggaagaccagtggtattctcattggcagctgaaggagaggctggagttagaaaggtgcttcaaatgctacgtgatgagttcgagctgaccatggcactgagtgggtgtcggtccctaaaggaaatctcccgtaaccacattaccaccgaatgggacac

SEQ ID NO: 7365 - DNA, 646 bp, Artificial
  Synthetic
tcggcaatgttgatcttagtacaaccattttgggcttcaagatatccatgccaatcatgattgcacctactgcaatgcagagaatggcacacccagaaggtgaattagccaccgctagagctgctgcagctgctgatacaatcatggtactttcatcatgggctactagtagtgtggaggaagttgcaagcacgggacccgggattcgctttttccagctctacgtatacaaagaccgcaatgtagtggcccaacttgtccgaagggcagaacgagcgggcttcaaggccattgcgctaaccgtagacacacctcgcctaggtcggagggaatcagacatcaagaacaggtttgtgctacctccacacctatccctgaagaattttgaaggtctgaatttggggacgatggaaaaggcagaagattcaggccttgcctcatacgttgcggggcaaattgacaggtctctcagctggaaggatattaagtggctgaagacaatcaccaagctccctatccttgtgaaaggtgtcctcacagcagaagacacaaggttggccattcaagctggagcagctggtataattgtgtcgaaccatggggcacgtcagttggattacgtgtctgccacaattgatgctctaga

SEQ ID NO: 7366 - DNA, 870 bp, Artificial
  Synthetic
gcgcgccttaataccaccattttgggcttcaagatatcagggccaatcatgattgctccaactgccatgcaaaaaaatggctcaccctgaaggagagtatgcaacagcaagggcagcatctgcagctaacaccattatgacattatcatcatgggctacttccagtgttgaagaagttgcttcaacaggaccagggattcgttttttccaactctatgtgtacaaggacagaaaagttgttgagcagttggttagaagagcggaacgagccggcttcaaggcaattgctctcactgttgacaccccaagacttgggcgtagggaagctgacattaagaacagattcactttaccaccatttttgactttgaagaattttgagggattggaccttggacagatggaaaagtcaagtgactctggacttgcgtcatacgttgctggtcaaattgatcgaactctaagctggaaggatgtgcaatggcttcagacaattacgaagatgccaattctagtgaagggtgttgttactgctgaggatactaggttagctatacaagcaggagcagcaggtatcatcgtgtccaaccatggagctcgtcagcttgactatgcaccagccaccatcagttgtcttgaggaggtcgtgaaagctgcacagggccgagtccccgtattccttgatggtggggttcgtcgtggaacagatgttttcaaagcattagctctaggagctgctggcatatttattggaagaccagttgtgttctcattggctgctgaaggtgaggctggtgtaaaaaaggtactccagatgcttcgcgatgaatttgagttgacaatggccctaagtggatgccgctcactcaa

SEQ ID NO: 7367 - DNA, 597 bp, Artificial
  Synthetic
gctggtcaaattgaggggctctttgagttggaaggatgtccagtggctccagacaattacttcattgccaatcctcgtaaagggtgtacttactgcggaggatgctaggattgcagttcaggctggagcacctggtattattgtgtcgaaccatggtgctcgccaactcgactatgtccccgccactatcatggctcttgaagaggttgtgaaagctgcacaaggccgtgtccccgtgttcctggatggaggtgtccgccgtggaacagatgtctttaaagctttggcacttggtgcatcaggggtgtttattgggcgaccagtcgttttctcattagctgctgaaggagaagctggtatcaaaaaagtattgcagatgatgcgcgatgagtttgagctaactatggcattaagtggttgccgttcactgaaagagatcactcgtaaccacattgtggccgattgggatgctccacgagctgctcttcccgcgccaagtttataaaataaaaccttaggtgtcaaattgtttcaccatgacaacgtattagttccacatgttttcaatagcttacttatctttcacgggaacactca

SEQ ID NO: 7368 - DNA, 604 bp, Artificial
  Synthetic
tcattttggcccaactcccaaaaaccccaccttcgcacccctccgttgttccgccgcctccgccacgccggaaaccaccaccacgacctccaccacattccacggcctctgctacgtcgttggagacaatatcgacactgaccaaatcatccccgcggaatacctaaccctagtcccatcaaacccagacgagtacaaaaaactcgggtcctacgcgttgtgcggactcccttcatcataccaaacccgtttcatcgacccggatgaattcacatccaagtactccatcatcataggcggcgacaacttcgggtgcgggtcgtcgcgtgagcacgccccggtggctttaggagccgcgggcgtggcggcggtggtggcggagtcgtacgcgaggattttcttcaggaattcggttgcgacgggcgaagtttatccgcttgaatcggaagtgaggatttgtgaggagtgtaagacgggtgatgtggtgactgttgaactaggagagagtaggttgattaatcatacgactgggaaagaatataaattgaagccaattggtgatgctggtcctgtcattgaagctggtggcatttttgcttatgca

SEQ ID NO: 7369 - DNA, 623 bp, Artificial
  Synthetic
cggtgcagttttgacgctgccgtattaactctcctccgaaatgtctgcatatgataatgtggttggcgggaagttgaaactaaagggaaaggcattggatgtaaaagccgctggaataaagaaaaagaaaaggaaagaaaagaaggattatgatcaaatctcccaggttacaggaaaagagctttcaacagatggtggtagtggatctttagatgatcccaccaaggaagagagcacagatgccactaaatctgttggtgaagaaaatgctggtcgctgggatgataatctaacccctgcagagaggcgctacatagaacaaagggagaggattgacatgcataagatggccaagactgctaataaatcacatcgtgaccgaatcgaagatttcaatcagtacttggcaaacatgagtgagcactatgacattcccaaagtcggtcctggttaattaataacaaatcagaaatttgctccatctctctatcttgtttatggttgttttgttttagcatatttaatagctacttttttgcaatttgtattatgtaatttagcagtttcctttgctagatggtgaagggaagccttggagtaatggtaaagttttctccgtgtga

SEQ ID NO: 7370 - DNA, 715 bp, Artificial
  Synthetic
cccccgaaccctcgcttctcggggacgcggagcggccagccggccaccttccactgcctcgagctcctctccttctccgggttggtgtggcgtggagatccatcctggccgacctctttcgctaggcgagatgtctgagtaccagaacgtcgttgggggtaggctcaagctgaaggggaaggcgctggatgtgaaggaagggggagtcaataagaagaaaaagaagaagcagcaccgcgaggagtcatctgaagccgggcacggagagcttcaccaaggtggaagctctgaagtaccagctgaccctaatgatgaattgactgaagctgataagatgggagaagaaggaaacctgcaaggcgactatgatcacctcaccccagctgagaggcgttacatggagcagaagcagaagattgacatgcataagctagccaaagtagccaacaagtcacacagggaccgcatccaggacttcaaccaatacctggcaaatcttagcgagcactacgacatcccaaaagttggccctggttaactttgcctattcagagcttcgcaggaatgcttcctatgctgtacccatccagccatctgttagcttgtgatgctcctacctgtattgttctaaaacatttggttgtcttcgagtgttgtatttcgaaaacccaaaccatgtttaattcaagtgttcgtattctgaaaaaaaaaaagt

SEQ ID NO: 7371 - DNA, 1114 bp, Artificial
  Synthetic
gcggggaagtccaacaagcacacgacccggatctggtcgtggatttggcattccctgggccagcgccccaaatgcagcggcttttctagatcttgaaagcgattccttgatcgtctcctgccatggcgtcgcgctacgattcgaatccattcgacgaggaagatgtcaatcccttctcggaccctgctgttcgtgctcaaatgacggggaagccatcgtatctggggaacaatttctatgaatcgcaaccatacaatgttcctcaggtgaactcgatatctcctctagcaccggagcggacctcggttggagatgccaccgtggaaattcccctgggcaacatgaaggatctgaagaaacgggaaaaggagttgaaagacaaggaagagcaactccgaaagagagaagccgaagtgaaaaggcgagaggacgctgcatcaagagctggaatcgtgctcgaagacaagaactggccgcgctttctcccgatactgcaccatgacattgcgagcgacatcccgcagtacttgcagcgcatcatgtactacgcatatggaagctggctcggaattctcttatgtttgacgtggaattttgttgccgtcactggagcttggatccaaaagactgtcagcgcttcctatggtgtgcagatatggttcctcgctattatctacattcttgcgggctttccggggtccttcttcctctggtacagacctctgtaccgtgctatgaggtcagagagcgcgatcaagtttggatggtttttcatcgcgtatctgttccacatcctgttttgcatcttctgctgtgtcgctcctcccgtcgtgtttaaaggacgatcaatcacgggcattctaccggcgatccagatcttctcagacagcgtcattatcgggatattctatctcgttggctttggtctgttcgtcctggaaactctcctcagcctatgggttctccgggacgtgtacgcgtacatccggggtacaggcaaagcggcacaattgaagagagaggcagctcgcaacgttgtaggcgctgcgatgtagaagtgcaagcaactggcttttggagtagtatgtatatgggatcacatttttttgcctgc

SEQ ID NO: 7372 - DNA, 831 bp, Artificial
  Synthetic
gaattttctgttcttcttgatttcctcgaatagttttggtcttctcaagacatttcccctttttgccttctctgctaagcttctcttctatttttgctactattcagatctcatctttaaagcaaaactcagaattggttgaaatggcgggccgttatgatcgaaacccttttgatgaagaagaagaagttaatccttttgctggtggtggaggcagagggaaagcttcagggcaatcaaattttagtggaggtgcatttaatatcacatctggtagtgtgcctccagcaacaaactccaggctttcaccccttccaccagagccagctggcttctatgaccgcgatgcaccaattgatattcctcttgatagtgcttcggacttgaaaaagaaagaaaaagaattacaggctaaagagagtgaattgcgacgaagggaacaggaactaaaaaggagagaagatgctgcagcaagagctggcattgttatcgaggagaaaaattggcctccgttcttcccaattatccatcatgatattgcaaatgaaataccaattcatcttcaaaagctacaatatgttgcatttacaacattcttgggacttgttgcatgccttttgtggaacatcgtagctaccactacagcatggattaaagaaggagatgtaaagatctggttcctttccatcatttacttcatatcggcggttcctggagcctatttcatgtggtatcgtcctctgtatcgcgcttttagaactgagggtgccatgaagtttgcgtggtttttcttgttttacatggttcacattatattctgtatcttcgctg

SEQ ID NO: 7373 - DNA, 535 bp, Artificial
  Synthetic
ggggtatgatactttcgtaaacgcgcatcttgcttgataaatacatatatatactcatttgccgcaagattccagttccagatctgtgactgccaacattgcttcattcgaaattgctccaatggctggccgttacaatgataatccttttgctgaagatgaagtgaaccctttcgcgaataatggaagtgtcgcccctgctaggccttcccctcttcctcatgaacctgctggctatgaccgcggcgcatcggttgatattcctctcgatgggtcaaaggacctgaacaagaatgataaggaactccaagctaaagaggctgaactgaaaaaaagagaacaggagcttaaaaggcaggaggatgcagtaacaagagctgtggtagttatagaggagaagaactggccacctttcttgcccatcattcatcatgatatcgcaaatgaaattccaatccatctacagaagctgcaatatgttgcattcactacattattgcgtttggcagtctgtcttgtatggaaccttgtagct

SEQ ID NO: 7374 - DNA, 502 bp, Artificial
  Synthetic
gttgctgctgtggcacctccaattttcttaaggggaaatctttgactggtatcttgcctgcaattgatcttttgggctggcatgctttggttgggatattctacttcgttggagctgcattcttctgtcttgaaacactgatgagtatatgggttatccagcaagtctacatgtatttccgtggaagtggaaattctgcagagatgaagaatgaggctgcaagatcgactatgatggcagcattataattaacatcaatgtggggtgcaattttgggcttcgggtttgttaaattctttgattgcttattcccttacaccttaactggattcctgggtgtttctgaagtacatagtggtgatcacagagcatttgaacaacactgatgttagtgtaatacttacccttgtctgggatttttctttacactcatggccctctgcgaacagcctgaccttatcttgatatcaaaattctttgaaatgcttcatggttttcctat

SEQ ID NO: 7375 - DNA, 654 bp, Artificial
  Synthetic
gcaaaaggaactagcagcttgggcagaagatctggaaagaaaagaaagggagataaaacgaagagaagatgctgttgctagtgttggtgttccgaccaatgataagaactggccgccattttttccaattattcatcacgatatagcaaatgaaataccagttcatgctcaaaggatgcagtatttggcttttgcaagttggctaggtatcgtgctttgccttgtgttcaatgttattgctgtcactgtttgttggataagagatggtggtgtcaaaattttcttgcttgctgtaatatatgctttacttggatgccccctttcgtatgtattgtggtatagacccctttataatgcgatgaggacggagagtgcactaaaatttggttggtttttcatgttctacatgctccacattggattttgcatacttgctgctattgctcctcccattatctttcacggaagatccttaacgggcatacttgcggcaattgatgtcttctctgaccatctcttggttgggatcttttatctgattggatttggccttttttgcttggaagttttgctaagcttgtgggtattgcagaaagtctacctgtacttccgtgggcacaagtgagcatgagtttggatccaattagctgcatt

SEQ ID NO: 7376 - DNA, 147 bp, Artificial
  Synthetic
cccacgcgtccggactgcttgttattctgataactaaatttttcaatcttatgaacctttaattttttcatagccatggctaatcgctatgatccaaatactttcgctgaggaagaagaattcaatactttcgctaatgctatagga

SEQ ID NO: 7377 - DNA, 665 bp, Artificial
  Synthetic
tttagttctctgtctcacacacacacacacacacacacacacatcgcagctgcttcgtcttgcatcgagtttttcagccatggaggctctacagcatttggaatcactttgcaatgcccatccagagctctccgattggtacactacgctatcagatctgtaccaaagaaagctctggcaccagcttactctcaagcttgaccagttcgtttcacttcccccttttcaggctggtgatgcactaatacagttgtatgacaacttcatcactgattttgagacaaagatcaattttctcaagcttgcacattttgcggtcattgtttctcggcaataccccgagaaagaggctgctataggtttccttgaaggagtgactgagaaacttcgtaatactaaagagacacggatagaggagccaattctttatattaagatgcagattgccctgtttaagcttgagcaaggggatcaaaaagagtgccagaaacttttagatgaagggaagactgcacttgacagtatgactgacattgatccatctgtttatgcgagctattattgggtttcatctcagtatcataaagctcgccaggacttcgctgagttctacaagagttctcttctttatcttgcttacacttcagtggaatctctttctgaat

SEQ ID NO: 7378 - DNA, 616 bp, Artificial
  Synthetic
ccgctttagagtacttagattcacttcgaaatgcacatccagagctgggcgattcgtacaatacgctatcagatctgtaccagcgcaagctctggcaccagctctctcttaagcttgaacaattcgttgccctcgccgtttttcaggcaggcgatgcactgatacagctgtatcacaatttcatctctgattttgagacaaagatcaatcttctcaagcttgcacattttgcagtcattgtttcccggcagtatgcagagagagaagctgctataggttaccttgaaggtgtgatcgagaaacttcaaaatacaaaggagacacgcatagaggagccaattctatacattaagttgcagattgctctatttaagcttgaacaaggggatcaaaaagattgcaagattcttttagaagaggggaaaactacacttgacagcatgactgacattgatccctctgtttatgctagctattattgggtttcgtctcaattccataaagctcgcctggagttcgctgagttttacagaagtgctcttctttatcttgcatacacttctgtggaatctctttctgaatcgtttaagctggatttggcgtttgatttatccct

SEQ ID NO: 7379 - DNA, 669 bp, Artificial
  Synthetic
ggagggaaaaagaagggaagaggagagaacagaagcgaagaggagagagagagggagagatagatagacagaggtagagagagagagaaggagaaggggagagagaagatggcaggagtagggcccatagtgcaggattgggagcccgtagtggtccgaaagaagaccccgaactcggcctccatgaaagatgagaaggctgtcaacgccgctcgccgtgctggaggacctgttgagaccatcaagaaacataatgctggatctaacaaggctacatcaagcactactagcctcaacacaaggaaactggatgatgagaccgaagtgttatcgcatgagaaagttccatcggaaatgaaaaaagcgatcatgcaagcacgcttagagaaaaagcttacacaggcccagcttggtcagcttatcaatgagaagccacaaattattcaggaatatgagtcagggaaggcgattccgaaccaacagattatctcaaagcttgaaagggttttaggaacgaagcttcgaggcaagaagtgaagtgaatttttagtagtagtaatttactcaggggggggattgcttggaaagcatcttgtacagaaaatgtagtagtggctaagaaacagtctctaggtactactactactactactactactatcactacta

SEQ ID NO: 7380 - DNA, 608 bp, Artificial
  Synthetic
ggagagagagaaggagaaggagaaggagagaggagagagaagatggcaggagtggggcccgtagtgcaagattgggagccggtggttgttcggaagaagaccccaaactcagcctccatgaaggacgagaaggctgtcaacgctgctcgccgcgccggaggacccgtcgagaccatcaaaaaacataacgctggatctaacaaggccacatccagcactactagcctgaacacaaggaaactggacgatgagactgacgtgctgtcacatgagaaagttccgtcagaaatgaaaaaagcgatcatgcaagcacgcttggagaaaaagcttacacaggcccagctcggccagcttatcaatgagaagccacagattattcaggaatatgagtccgggaaggctattccgaaccagcagatcattgccaagctcgaaagggttttaggaacaaaacttcgaggcaagaagtgaaatgatagtgtttaaaaaacatcttgtacaaaaaatgtagtgactaagagacataaacaaggtaccgttactacttaagcttctactgctaatactactattactgatactttatatatataaataatatattatgc

SEQ ID NO: 7381 - DNA, 609 bp, Artificial
  Synthetic
tttctctaaaagaagaaaagatggctggaatatcacaagattgggagccggtggtgattcgcaaaaaagtgccgaccgccgccgcaagaaaagacgagaaagcagtcaacgccgcccgtcgcaccggtgctgagatcgaaaccgtcagaaaagctactgcagggtcaaacaaggctgcatctagcagtacaacattgaacaccaggaagcttgatgaagataccgagaacttgtcacatcaaaaggtaccaactgaattgaagaaagccattatgcaagcacgacaagataagaagttaactcagtctcaacttgcccagttgataaacgagaaaccacaaatcattcaggagtacgagtctggaaaggcaattccaaaccaacagataatctctaaactggagagagctcttggtgctaaacttcgcggaaagaaataaaggttggaatagtgaaccttttggattagactgtctggttgtatcctaaaagtggtcatgtacatgagcttttttactttaaccactatggtacttgttgtatctggattcatgatgtggttttcgtggttgacttgggtgttttttcttgtgaaaaatgaggtgctta

SEQ ID NO: 7382 - DNA, 780 bp, Artificial
  Synthetic
cggtgcccatcaattgcgactccagaaccgtctcttcttccttgttcgttcatcccctaaccctttctttgttcatcttgttcttcctcttgtcgtctcgtcgagatggccgggattggtccgatcaggcaggactgggagccggtggtggtgcggaagaaggcgcccaccgccgccgccaagaaggatgagaaggccgtcaacgccgcccgccgctccggcgccgagatcgagaccatgaagaagtataacgctggaacaaacaaggcggcgtccagtggcacatccctcaacaccaagcggctggatgacgacaccgagagccttgcccatgagcgtgtctcaagtgacctgaagaaaaacctcatgcaagcaaggctggacaagaagatgacccaggcacagcttgcacagatgatcaatgagaagccccaggtgatccaggagtacgagtcaggtaaagctattccgaaccagcagatcatcgggaagcttgaaagggctcttggaacaaagctgcgcggcaagaaataatgttctactattaggccctgaagcatagtgttggagcaaccaaagccaaaatgtttgcgtaacctatgctgggtcttttgataccatgcaggatgtttctgttggtgcatgagtgaatactgaataactattatgttgtcgcaaaccttgtaatgctgccgctctttgtgtgtcatagtccctagtgtgcaagagttgtgctggaccttaaaactgacttgataacctgcgtggtttatgcatgat

SEQ ID NO: 7383 - DNA, 768 bp, Artificial
  Synthetic
gggcggacgcgtgggaaaaaattcatatacaaattagagatattttcaaagaagaaaaaagatgagcggaatagcacaagattgggaaccggtagtaatccggaagaaagcgccgacctccgccgctcgcaaggacgagaaagctgttaacgccgcccgtcgctccggtgctgagatcgaaactgtcaaaaaatctccgctcgcaaggaagaaagccgtcaacgccgcccgtcgctccggtgctgagatcgaaactgtcaaaaaatctaatgctggctctaacaaggcggcctcaaacagtacatctttgaacaccaggaaacttgatgaagacactgagaatttgtctcatgaaaaagtaccaactgaactcaagaaagctatcatgcaagcacgacaacataagaagttgactcaagctcaacttgctcaattgataaatgagaagccacagatcatccaagaatacgagtcaggaaaggcaattccaaaccagcagattatctctaaactggagagatctcttggagcgaaacttcgaggaaagaaataaagcgtagtggcacaagtgaaccttatggatactcactgtctggttgaatccaagatgcggtcatgtacatgaacttttctttaatcactgtgttgcttatcgttatgcctggattcatgactatgttccttgttgaattagctgtttcttctgtgaaatttgaagttcctcttgtacgaatttcttttctgcttattggattactctgtcgttta

SEQ ID NO: 7384 - DNA, 667 bp, Artificial
  Synthetic
gcgaaacaaaagctagggtcaagagggagatctttttccgagaagaagaagaaaaaaaggatgagtggaggaatagcacaagactgggagccggtggtgatccggaagaaggcgcctaccgccgccgcacgcaaggatgagaaagccgtcaacgccgcccgtcgctccggtgctgagatcgaaaccatccgaaaatctgctgctggcacaaacaaagctgcctccagtagtacgaccttgaacaccaggaaacttgatgaagatactgagaatttggctcatcaaaaggtaccaactgaactgaagaaagccatcatgcaagctcgacaagataagaagctgacccaggctcaacttgcccagttgataaatgagaagcctcaaatcatccaggagtatgagtctggaaaggcgattccaaatcaacagataatctctaaactggagagagctcttggtgcgaaacttagaggaaagaaatgaagtgccttttgggtttctcaaatctccgttccagtcctaaaagtggtcatgtacatgaacatcttcctatgttagccctctttctgtaaccactttggtgcttgtgcctgtgtatggattgatggttgaggatttcctagctaaacgggtgttactaatatggaaaataaaggcgtttatgctt

SEQ ID NO: 7385 - DNA, 700 bp, Artificial
  Synthetic
ccccccggtgcccatcaattgcgactccagaaccttctcttctctcaaccctttgttcatcttcttgttcctcctcttgtctcgtctcgatggccgggattggtccgatcaggcaggactgggagccggtggtggtgcggaagaaggcgcccaccgccgccgccaagaaggatgagaaggccgtcaacgccgcccgccgctccggcgccgagatcgagaccatgaagaagtataacgctggaacgaacaaggcggcgtcaagtggcacatccctcaacaccaagcggctggatgacgacaccgagagccttgcccatgagcgtgtctcaagtgacctgaagaaaaacctcatgcaagcaaggctggacaagaagatgacccaggcacagcttgcacagatgatcaatgagaagccccaggtgatccaggagtacgagtcaggtaaagctattccgaaccagcagatcatcgggaagcttgaaagggctcttggaacaaagctgcgcggcaagaaataatgttctactattaggccctgaagcatagtgttggagcaaccaaagccaaaatgtttgcgtaacctatgctgggtcttttgataccatgcaggatgtttctgttggtgcatgagtgaatactgaataactattatgttgtcgcaaaccttgtaatgctgccgctctttgtgtgtcatagtccc

SEQ ID NO: 7386 - DNA, 577 bp, Artificial
  Synthetic
aagagagagagagataagttgaatcgttgatccgtataagaggggggggagagagagagagagagagagagagagaagcggagggaaaaagaagggaagaggagagaacagaagcgaagaggagagagagagggagagatagatagacagaggtagagagagagagaaggagaaggggagagagaagatggcaggagtagggcccatagtgcaggattgggagcccgtagtggtccgaaagaagaccccgaactcggcctccatgaaagatgagaaggctgtcaacgccgctcgccgtgctggaggacctgttgagaccatcaagaaacataatgctggatctaacaaggctacatcaagcactactagcctcaacacaaggaaactggatgatgagaccgaagtgttatcgcatgagaaagttccatcggaaatgaacaaagcgatcatgcaagcacgcttagagaaaaagcttacacaggcccagcttggtcagcttatcaatgagaaggcacaaattattcaggaatatgagtcagggaaggcgattccgaaccaacagattatctcaaagctt

SEQ ID NO: 7387 - DNA, 603 bp, Artificial
  Synthetic
cccccgacaatccagtcctcgaactcgaacccagccatggcgaccaagcagagcctcctcctcctcctcgccctcctcgccgccgccgcggccgtcgcctccgccgtcaccgacgtcgagtactgcaataagggcaagaagtacccggtgaaggtgagcggcgtggagatcgtgcccgatccggtcgcccgcggcgagcccgcaaccttcaagatctccgcttccactgataaaactatcggtaaagggaagctggttattgatgtgaaatacttcttcttctatgtccactcggaaactcgtgagctctgtgatgtgacttcctgcccggcaagtggtgacttcttggtagctcatcagcaaaccctgccatcatacactccaccaggctcttacaccatcaccatgaagatgctgggtgataacgatgaggagctgagctgcatctcgttcgggttcagcatcggtttcgctgcatcagaagccaccatctgaatgcatccagaggcagaattcagaaatatcacaccatggatgtaattacaaaagcacctatgtatcttagatcatagaactcaaatacaatgcgcatctgccaacaca

SEQ ID NO: 7388 - DNA, 679 bp, Artificial
  Synthetic
attcattgatagatagatagagagatagagagacagagagagagagaaagaaagaaagaaagaaggaaagaaaggccaagggcacaagttcaaaaccatcgatctcttctacaatagaatgagcaatctaagaaggatgtgctatctctttctggttttgatcagtaccttctttgcacttgtgaatgcaaaggttacatggcagtcctgctcatcaagaatcgactacaaagtggatgtgcaaggtgtcagtgttattccggaccctgttgtgaagggagtcgatgcaacatttaaaattcctgccatcacaaaggatccaattaccggaggcacagtggtgatagatgtgtactactttgggattcatgtacactctgagaaagatgatttatgcagcaaaacagaatgcccggttgcacctggagagtttacacttacgaactcccaacctctacccaatttcacaccatctggatcttatcgtctcaacatgaatgtgtacgacaccgatggaagtctgctgacttgtgtcaaaatcagctttaaaatagtgggatcagtcaatcagcttgaatccagtgatttgaacaggttttccgaagatcgattcgtgcatgaagattgatacaaggctatgtcagtttcaaacaataaatgtaaatatgggatgaaagtg

SEQ ID NO: 7389 - DNA, 646 bp, Nicotiana benthamiana
ggaaatattattgggagagaaatgaaatttcacctttggtttgaccccactcaagcttaccacaattatgctatcctttgggatcccaatgagatcatattttttgtcgacgatgttccaatcagaagataccctaggaaaaatgatgctacatttccacaaagacctatgtatgtgtatggttccatttgggatgcttcatcttgggcaacagaggaaggaagaattaaagccgattatcggtaccaaccattcgtcggaaaatataacaattttaaaattgctggttgcactgctaacgagaacccttggtgcggacgctcgccctccagctctccgtctagagctggtgggctgagccgccagcagatagcggccatgctatgggtgcagaggaactataaggtgtatgattactgtcgggaccccaggagagaccatacccacactcctgagtgttagtacaattcgtaaaaaatgcattatttgcataaaatttcatactgttagtgaatataagctgaaatcacgaataagaggaatgaaacgtgtaaaggaatatttggtcatttcaccagaattgactttcaattgtactttatctttgagtaaatgttttttgttttttaataaaaaaaaaaaaaaa

SEQ ID NO: 7390 - DNA, 872 bp, Saccharomyces cereviseae
ggaattccagctgaccaccatgatctctgtcatggcggatgagaaacataaggagtattttaagctatactactttcagtacatgataattggtctatgtacgatattattcctctattcggagatatccctggtacctaggggccaaaacatcgaatttagccttgatgaccccagtatatcaaaacgttatgtacctaacgaactcgtgggcccactagaatgtttgattttgagtgttggactgagtaatatggtcgtcttctggacctgcatgtttgacaaggacttactgaagaagaatagagtaaagagactaagagagaggccggacggaatctcgaacgattttcacttcatgcatactagcattctatgtctgatgctgattataagcataaatgctgccctaacaggcgccttaaagttgattataggaaacttgaggcctgactttgttgatagatgtatacctgacctccaaaagatgagtgattcagattctttggtttttggcttggacatttgcaagcagactaacaaatggattctatacgaaggcttaaaaagcactccaagcggacattcaagtttcatagtcagtaccatgggctttacatatcttcggcaaagggttttcaccacacgcaatacaagaagttgcatttggtgccctttattagctctagtagtaatggtttcaagggttatcgatcacagacatcattggtacgatgttgtctctggagctgttctagcatttttagtcatttattgttgctggaaatggacatttacaaacttggcgaaaagagacatacttccttcaccggttagtgtttagcatggcaattcccggggatcgcggccgc

SEQ ID NO: 7391 - DNA, 1318 bp, Trichoderma harzianum
ctcgacccacgcgtccgcaaagaatccgcggccgacgtgcccaccaacgggcactatgtttccaatggcatgggctctggacagcaattccagccccagcagtatcagcagtatccgggctatggacaatttgttccgtttagcaacacccaagatcctcgggctgggcctcaccaggccatgatctcccaggtctaccaacctacccttggtaagattggtaacccaggtcctcttggtctgatcggtttcgctttgacgaccttcgtgctcggactttaccagtgcggtgctggtctccctaattccaacccattgggcaacgtcggccctgatcaagctgtcttcggtgtggctgtcttcttcggaggcatggctcagtttgttgctggtgtcatggaatttgtccttggcaataccttcggttgtactctccactgttcatacggggctttctggcttgcctttgccatgttctcagtccctacactgggcatccaggccgcttataacggagatcaacgtgcctttagctttgctgttggcattttcctcatcatatggtgtttcctcacaatcatcttctttgttgcggcgctcaagacaaactttaccatcttgatggtgcttggcctgcttgcgctgtctttcttcttcctcagcattgcacagttcgtctcaacggagcacaccactgcggcggtgcgattgaaccgcgccggtggtgcctttgccgtcttctgtgccatgtttgcattctatgctggagcggcaggcctcatgctcaaagacacaacctttgtcacctttccgcttggagagattccatatccctcagtcaagcgagagagggccgcagccgcggcgaaaaatgtctagagccacgaatgatgtcaattcatggttgaaatatgtgactcattttattgagtacttcattcccggctttcaattattgagagaatgtaatgcgctgaaggatgaaatggtcgaagacggacaataagttcaccaggtgggacgaagaggggagttgaatgttgttcggctttgtctgtgtgcactgattataccctcgcttttgatacccacctgctcatttgtttttatgttttatatagtctctgtgcgaagtatctgtggtggcaagggtaatggcagtggacaaataatatggatggaatactggagggaaaaccctccaagttcaataattatacccaaatgctgcagacggcaaaaccaactgtttgtcattttacgttttgatgaaatatttccaattaaactaattatcaaaagcaaaaaaaaaaaaaaa

SEQ ID NO: 7392 - DNA, 314 bp, Trichoderma harzianum
ctcgacccacgcgtccgagcagaacggctgtatttgtatgtatccatcattggatggcgttttctggagcgagtgcgaagcatgcgtactcgtatgtgtatgtctatgtatggactaatgtgcgtgggggttcatggaatcgccatgagtgctttcatgattctgcaatgccgttttgcgtcagtaatgtggagggaagatgtacgactatggatcatgtatatcgcaagtttgatttgtcggaacagcgtatcatcagggagaagatagaattagcattgcacaattcaattgcaaaaccaaaaaaaaaaaaa

SEQ ID NO: 7393 - DNA, 295 bp, Nicotiana benthamiana
aataaattggtagttggtgttactgttcgctgagggaccagatccagagttcaacgactgcatcgcccctcgccttttagtgtcaaaattctctattttctgactgttgctggtctttaagagtagtttgtattgcattacctgcgcatcacaatccccccatctttatttcgccttttctattgttgtatactgggggttggtaagagctagttggatgtgtgttttctctgttttgttttaattcttacacggataaatatttgggttctccattaaaaaaaaaaaaaaaaaa

SEQ ID NO: 7394 - DNA, 407 bp, Nicotiana benthamiana
accaaattaagtcgaaaaaaaaatggcaactcctgaagaaaacattgcacctgcagctccaccaccgccggcggcagaaccatcagcggtggaggctttagtgaccactattgaaacagcgaccaaacaggttgaaacaccgaaggaagtcaaggaggagaagaaaggaggagcacaggatctcaagttaacccttttgattccaggggctgtagtagctgttgttggagtagttcttgccattgtcaagaaggtgaaagagtcggctaattgaatgtagatcccttgtatcgtcaactttatatttctgtacattttttccccctttttgtaagacgagcctaaactctttgtcagctttgaagggaaataaataaatttcatatgcttttaaaaaaaaaaaaaaa

SEQ ID NO: 7395 - DNA, 571 bp, Nicotiana benthamiana
ggccattacggccgggcatcaaattgggccctgagaaagataagcggaaagaggcagttgaaaaggccaagaagactcaaagcataaatgagtttctgaaacctgctgagggggaaaattactatcgaggtaggggacgtggtggccgtggaagaggtggctatgggggtaacggtggtaacaactacagtgttgaagcccccaagattgaggatgttggccagttcccatccttgggtgccaagtaaggctccccagaaccagccgtctaagctcattctctgtttcggccatacttatatgctcaatgacggcagatcatctccaagactcttttcgtgggttttcatgtattagaatcatctgaaaactttattgttctttttaagagtgtaaatttagatgtctcttctggtattttacacccttggtctttcttgacttttgacatgcatgaataccctttctttcataattaggatttaggtccatttttgatttagttgtgggatcattttgtttttgaattttattaaaaacaattttgctccgttgcaaaaaaaaaaaaaaa

SEQ ID NO: 7396 - DNA, 449 bp, Trichoderma harzianum
actcgacccacgcgtccgcaaccactcggcacatcatgagttcaggatacggcatgcatggcggcgtcggccgttgctttcctttctggcaggaggtcatggcctgctatgtcgtcaacacatccgccgcagacgactcaggcaagaagaagtgctcgcccgtactagaggattactacgagtgtctgcaccacaagaaggagcatgcgagagcgctggccctacaagccgcatatgcccgagctcaatcggcaaccgcacgagacgatgcgccaagtgccagccagatccggaatctaggactgctagggaagacggaggacacaaaagcggtgcttggacagggaaactgaggcaatagacgtggcggagttcgatttcttctgcgcgaatacaacccccttggcgcgcatagatagcgcagcaagttcaatataggaaaagcagac

SEQ ID NO: 7397 - DNA, 1367 bp, Trichoderma harzianum
ctcgacccacgcgtccgcagagacacacgcacacatggattcgagcgccttcgttttgacctacccaattgtacggccctagcccacggtcttgcaaatggcgctcagacagcagcaaagcaggcgcaggcgcagcccccattcgagacgagaaacgggcctttgattgggggcgtccgtgtgacccgaagtgctatatctactgcagccgctgcccgcctcgtcgaagcttcttttccgcatctcccctcagaagcattttgcaccaggactatccgccgatagcatatattttttccctaaggcttacgcgcaaattccgatttcttacggacctacacgtacttcagttaaagtccaatcgcccaaaatgaacaccagcaccgtcaagagccgcttcctttctcaccccgaggaccttggtattgtcaccgtaggcttctcgggcggtcagcccaaagccggtgtggatgcaggccctactgccctcatcgagtctggtctcttgacccagattcgagatgagcttggttacaagctgcacggtgatgagacggtcaagttctacaacgacctgactcccgcgtccgaccccgactaccgcggcatgaagaaccctctccttgtctcggctgtcactcaaaagattgcatctgagacatacgagcactcttccaagggccgcctcacgttgacgcttggcggtgaccacagcattgccattggcactattgctggaactgccaaggctacgcgcgagcgcctgaaccgcgaaatcgccgtcatctgggttgatgcgcacgccgatatcaacacccccgagacgagcgacagcggcaacatccacggcatgcccgttgccttccttaccggcattgccaaggaagagaaggaggagtactttggctggatccaggatgacatgcgcctgagtgtccgcaagcttgtgtacattggtctgcgcgatgtcgatgctggcgagaagcgcatcttgagagagcatggtgtcaaggctttcagcatgttcgacattgaccgccacggaattggccgtgtcatggagatggccctcgcccacattggcgacgacactcccatccacctgtctttcgatgtggatgctctcgaccccatgtgggcgcccagcactggtactcctgtgcgaggtggccttactctgcgtgagggtgattacatctgcgaggtggttcaccagaccggcaacctggtcgccattgacttggtagaggtgaacccaagccttgcagccaccgaagccggagcacaggagactgtcagagccggttgctctctggtgcgctgtgcactcggcgagacttgctgtagagtggttttttttttttttg

SEQ ID NO: 7398 - DNA, 1887 bp, Trichoderma harzianum
attgtcgcctcggttccacggcttcggattggaacacgcgcccacagacagaacgctccgtttcccattgagcgtcaacctctactgagctttcatcaatcagtacgaggccatcttcgacaattttcagaaaaagaaaaaagcctttcgagaacatcaattcggaaagaagagccacttcttcaccatggctgatgatgagaagcacgttgcggagcctgccatttcggacgtcgcccccgtcgactcctatgcggctgcccagaacgagtttcatgaccggcctcccggatggatttacaagggccacaagatcttcggtagggagatctactatgcctcacccagagtccagctcgtgctggttgctctcgtgtgtttcctctgccccggcatgtacaactccttgactggtctgggaggtggtggtcaggtcgaccccacggcccaggaccactccagtgtcgccctctacagcaccttcgccgtcgttggtttcttctctggtacttttgccaaccgtcttggtctccgtctcactctcggctttggtggtctcggatactgcatctacagcgcctctttcctcagctacaaccacaacaagaacatcggcttcgtcatcttcgccggtgctttcctcggtgtttgcgctggtctgctctggaccgcccagggtgctgtcatgatgtcctaccctcctgaggacaagaagggtcgctacattgccaccttctggatcattttcaacctgggtgccgtcattggctctctgattcctcttgctcagaacatccacagccacagtggaactgtcggcgatggcacctacgctgctttcatcgtcctcatgttcctcggcttggtcctctgcttcttcctgcttgacgctgacaaggtcattcgtgaggatggcaccaagatcgtcctgatgaagaacccctcgtggacctctgagttcaagggtctttgggagactctgtacaacgctccctatgttctcctcctcttccccatgttcttcgcctccaacatcttctacacctaccagaacaacgacatgaacgccgccgccttcaacatccgcacccgatccctcaacaacctgttgtactggctcgcccagatcatcggtgccgtcatcaacggctttgctctggattacactggggtcagccgtagcacccgtgccaaggcctcctttgtcttcctcttcatcctcacttttgccatctggggtggtggatatgcctggcagaagatgcagccccctcgctccgtcgtttcccagcccgactacgaatctcagaaggttgactgggaagatggtggcaagctcttcattggccccatgttcctgtacttcttctacggcttctacgatgctatctggcagaccaacatctactggtggatgggttcattgtccaactctggtcgtaagactgccaacatggctggtttctacaagtccttccagtccgttggtgctgccattttctggcgccttgacggtcttggcaagccttacatgaccatgttcgccgccacctggggtgtccttgccggatctctccttctggccgcccctgtggtcttcctgaagatcaaggaccacgtctccatcgaggaggatctcaagttctccgacgagactattcaggatgtcgttgttggtgccaacaaggacgttgatgtttagatttacagtgggcggttaatgaatgacccgaagaggtcgagtggggagtgaatgaattgtgaagcgttttcgaacgatatgctcctgatttaaatgatttaatgcaaggcttcatacaagcctcctattcccctattagattcaatacgaagagcacgttattgctgtgtaacaaaaaaaaaaaa

SEQ ID NO: 7399 - DNA, 2408 bp, Trichoderma harzianum
caaggcgtaatgccaggcagcgtccaccgcctttcgccagctgcctaatctctgccaatgccaatcatcatcacccattagctggctaaactctcacaattcccacttccccaaaacccactgctgcaggagtgctgtgccaattgctggcccacgagctcgaggacgtcgaaccatgactgcagaagcaagcgggcgtcaggccccggccgagtcggttgcaccggcttcggagcgcacgccgttgttgggatccggcgcgtcagagtcacgcacagacggcagtggattgacgggggcggcggcagcagcggcggcgattctgagacggcatcagcgtaatgagagcgagaatgagcggctgctggccggaaacgacgacgacgatgatggcgacaatggcaatggccaggaggaggagacgacggtggtggccgaggaagtgtccttcgccaagctgtgcctcatcatgggaaccgcctacctaggtgtcttcctcggggcaatcgattcgtccatcatcgccacgctctcggcgcccatctcgagtgaattccagtccctcagtctgctctcatggctcgcaactgcgtatctcatctctaatgcggcctgccagcccatctcgggtcgtctgacagacatcttcggccgaggcccgggcttagtcgttagcaacttgttctttgcagctggcaatctcatctgcggcttggcgcaaaactcgagtgtcatgattctcggccgtgttatcgcgggtatcggtggtggcggcctgatgagcatctcgacatttttggggtccgacttggttcccttgcgcaatcgtggtgttgtccaaggcattggaaacgtatgctacggctcaggggccatgatgggaggcatctttggcggattgatgaacgaccacaccaaaatgggctggaggctggctttcctcatccaagtccctcccgccattctctccgccatagccgtggctatcctcgtcagagtgccaccaaagcagtccaacaaatcttaccttgcacgaatcgactttggcggcgtcttcttcacggtgtccttcctggttctcctgctgctcggcgtcaatgctggcggaaacctcgtaccttggattcatcccctgcctcttacgacgatcccgctctccattgtggcatttgttggcttcatttggtgggagagcagagcgatgcagcccatcatcccagtcaggctcctcctcgatcgtaccttattgtctgcctgcttgtgcaactttcttgctaccatggttaccttgtcaggcatcttctacgttcctttatacctccaggttcgtggtgactcaccaaccgttgcaggcctgaaattgctgccttcgcctgttggtatctccatttgctctgttggagcgggctacattatgaagaagactggtcggtacatccggctgggcattagtagcatgctaatggtcattgctggaatcctcttcttcacctcgcagaatgaaaccagcccaggatgggtgacgatggtggctttcttcctggtgggcggaggttatggtgctatgttgacaacaactctgctggcgtgcattgcggcggttgatcactcacaacaggctgtcatcacatcagcgacctatcttgcccgaagtctgggtggtacgattggcatcacagccagctcagctgtctatcagaacgtgctcaacgctcgcttgtggcagcgattcggtgatgagccgcatgctgccgagatcattcaaaagatccgtgatgacctgaacttcttgaaacacctgccatcaggatggcatgatggggtgttgaagtcgttcatggaggcgttcaggggcgtctggctaacaatgctcaccttggccattggtgctctcatttgcgtatcgctcatgaggcagcacacactccacgaaactctctctaggcgatgagcgtgacaggctgccacatttgacggcaaacaagaatatgcttgccaagcgccagtagatagccctttggggctctttggcgcttgtcagctgtgatactatggaaccaggattcatttcacaactgctgcattcgatagaattggatatatggtttcgcaaacaggcaggcattcacatattgggagtaaggagcaatttgaagcagcaattttctcagaacgcacatccgcgtgggctccctttggatgaacatgtgacacttctctctttgttcactcgcagagcgcacatctacgtgtatttggctgaacatttggtactactggcttattgttcaatgttcactcgttcactgacccattcttgcctttgacgagcacgatatagaaataaaacggtcgctcttgccctagctctaagagatgttatagtagttctcaaaaaaaacaaaaaa

SEQ ID NO: 7400 - DNA, 2316 bp, Trichoderma harzianum
aagttgtgaaaggggttgcagatccaataatgccacgccgatccatatcgagcaatgtatttatacccaaatcgtccctttaccgaaaattccgagcctctctagcgctcgaatttatcaatttttgacgagtatccatgagctccgtgaaaatcaacaagagatttcaggacatatagaagggagggcttaacatatatggatataaatttttctattgcttcatccagcaacaaacccttactggagctcctgtcagccaccgtcgagatattcctggaggcgtcacaaaactctatgtcgatctcataagatcaatcgtcgttggcgcccatactgtactctgagctacaagtttgagaaaaatacttgggtcaacatacatttactacgtatcttgaattctcaccagcatgattgatggaatacagcaccacgttgagacataatagcttggtagtactgtacggggccgcctcaactatggagacgtctaaccgatcgcgagtttagctctcccggtacgagtagccgtcttccgggccggtatttggtgctcggacctgtttggaatatttttacctaaattggaacatggcagaagatgtttgttggctagcctttgaaagagtgagttcctctgctcctgacgccgatctagatcccagatcacaggttggtctgaactactgggtcgcacatgattattctcgtataagaaacaaaggtcgccttcgagaagtctgttgaaatcctttcacgttacgaagatgaactctagacaacttcaaggatgaaaatgtcgaaggagtatccgcttgacatagacaagtttgcgcggcccagtattggagcttttcagtcctttacgatcatgtctgcgcctaccgttgctcttattgttgccgctcctcagtggtgcacatacgagcccagaagaagattgatataaaacttctgagcagcgacatcaacagagacaaaatcttctcaaggtccctagtgtcggcaacttctttgatagaattcatagtaacgtcgtcctaatcaaaacatatgccaagcggccttgactacagtcggaattattgtcctagaaacaatctgttgaggttataaattactttttgttctattgctgacctgtagaattagggcaattaattggtaggttgagaatgacaatactgcgtagatggcaacgacaattggcgtccctgtggcacgtatgcgagggagactacaagttttggtatgcatggatttccacaattgtgcgtaggattcaagcggcatgaccacataactaaaacctagttcgcaaacccctcaattgtatcgctcaacaatcttcaacatcaaagctggccatagagccgcttcatcgacatcagccataatggcgactgctggtgacaattcggctttgtctgtggcaactctgagtcctgcatccattggggtggctgtgatttcgatcttgctgttgaaaatcctatacggactgggcaccgaccgcctaggacacatccccggccccttcatcgctcgccttactccaatctggtactggtatcttacttggaagggcattgaatgcacagttattactgccatgcacaagaaatacggacctgtggttcgcattgccccaaatgaaatcgacatttccgatggagcggccgtcaatcccatatatgtcgacaatggtggttttagaaagatcgccgggtacagaaatttcgatatcaacggttttcctaccatattctcagtaacagatcatacacacagagcagtccgagccaaagctgtgtcgcccttgtttgcgcagcaagcaattacaaacagcaaactggccatgcagaaaattatcgacgcaacgatggttgagctagagcaccgaagatctttggcagcagatataccagttgatctactaaacctatttcgctccatggcgatggatgccttaacggagtatctgattggggagtgcttcaacagtgttggtactgaaagactcagcgcaactgctttcgtggataattttgctgcgggcggtcgcttcttttatcttccaagttggttattcacttttgctgataattgggctgcgaaatttgacaagaataatctggcaataaccatgagtacggatatggtccaggagtttgcagccaaggttgtggatgacagtatcgcgcaaggagagaaagaaacgtatcaaggacggctgctgcatgcaagtctctcacgagaagaggctatagcacaggtaatggatatcatgtttgcaggtaaaaaaaaaaaaaa

SEQ ID NO: 7401 - DNA, 1612 bp, Trichoderma harzianum
cgattcctcctttcttcccctccatactatttatcctgcctcttcctcgtcttccatctgttgccggtgtgactcttgcaattcattccctgcccggcttcctcgcttgattgaatagccgttgctacttccaactgcaaatcattatagctatacctccctagcttcatataagctcggctcttctaggaacgcgcaagcaaacatcctcggcagtgacccacgagccttgtctggagattttaaataggaaagctcatcaacggcacctgagcagcgtccaattgctctgttcagctcaattaagctttcaagatgcctagagacggcagtaaacaaccgccctcagcggcgacaaacctcatcgctggtggtggcgccggtatgatggaagccctcgcctgccaccctctagacacaatcaaagtgcgaatgcagctctctcgccgtgcacgaatgcccggcgccccccgccgcggcttcatcaagactggtgtagaggttgtgaaaaaggaaactcctctcgctctatacaagggcctcggcgccgtcttgacgggcattgtccctaaaatggctatccgattcacatcatttgagtggtataagcagctcctagccgataaaaccaccggcaccgtctcaggccgaggaacatttctggctggtctcgctgccggtgtgacagaagccgtggccgtcgtgacacccatggaggtcatcaaaatccgtctgcaggcgcaacatcactcaatggccgatccgctggatattcccaaatacagaaacgccgcgcatgctctgtataccgtcgtcaaggaggaaggcttcggagcgctataccgtggagtcagcttaacagccttaagacaaggctccaaccaggctgtcaacttcacggcatactcttactttaagcagtggctcaaggactaccagcctcagtataccgacggtaacttgcccagctggcagacaaccatcattggtctcgtgagtggcgccatgggccctctcagcaacgcccccatcgacactatcaagactcgtttgcaaaagactccagccgagtttggcaccaccgcttggacaaggataaccaccatcaccagcgacatgttcaagcaggaaggtttccacgctttctacaagggcatcacgcctcgcatcatgcgcgttgcacccggccaggccgtcacctttaccgtctacgagtacctcaagtccaagctggaaaagagtaacctggcctttgtcggtggcaaatatgaggagtaagaaaaaacggcagcacgtcgatgcattttgttgcgatatatacccttgcttttttcggccaaaaaaaaaaaacgagaggaagacatggtctgacctgtattgtagttctagagcagaaatgcgacagggtcagccccagcatgcttagggtttgtgagcgatgacggcgatgatagcggcgacggtgatacgatacggtggtaaacatgattgtttagaggttttaatggcagccatggattgtggcgttgggttgtgttcagtttcaaaatagtagagtggatatatcttcttgtataaaaaagtatggacaatgtctattctaaaaaaaaaa

SEQ ID NO: 7402 - DNA, 506 bp, Trichoderma harzianum
gggatcatcgtacatgatactattggcgacttggatttctaagagggtgtccaggcagggctcatttgtaagccgagccgatttgggatgacatgttgcagtgcatatgcatttgacagcgaggttagtaagtttctgttcaagtttagggcgtgtactatttgatgttgtgagatgtgaatttgatttccaagcactgcgacctgggcctcctgcgcgatcagaggtctctatgaggagatgagctattgattgcactcagcgctagatgtttgatgaaccctcaggacacagcattggaagtattattgatcagagaaaggctctgggctattcactccagagttgcgagaactatgattcacgttgacatacgtgtcgggcctgcaagaccgctggagcagccaacgtaaactgcagcatttcatccaacgaagaagagtcatattttgtagtaagagtagccaatgatggcccatctatcaagtacttgcaaaaaaaaaaaa

SEQ ID NO: 7403 - DNA, 1685 bp, Trichoderma harzianum
cgccacatttccatgattgccattggtggtgcgctcggcactggtctcatcattggtaccggaaaagccctcgctcaggctggtcccggctcgctgctcatctcgtattgtttcgttgggattctcgtctacggtgtcatggcttctttgggagaaatggctgcttggttgcctatgagtgctggatttacgggctatgcgacgcgatactgccacccttctctgggatttgctcttggttggacatattggttcaagtacatcattaccaccccgaatcagttgacagctgccgctttggtcatccagtattggtgtcctcgagacaaggtcaatccaggtgtcttcattgccattttcctagtcaccattcttgttgtgaactacctaggaattgaactgtttggcgaacttgagttctggctgtcctctttcaaagtcatcatcatcgttggtatcatcatcttctccttgtgcattgcctgcggtggcggtcccaacggcgatgcccctggattccgatactggcaccaccccggtgcctttgccgaactatattcaacgggctctttgggcaagttcctcggcttttggtctgtcatggtcaatgccacttttgcgtacctcggaaccgaactggtcggtgtcaccgctggcgaagctcagaacccccgacgaagcattcctaaggccatcaagctcaccttcttccgtatcctcttcttctactgcctcagcgtcttccttgtcggcatgattgtcccttacaacagccccgagctcaccttcgccaacaagcagagcaccggtgccaatgcttcgcccttcgtcgttgccgccaccctcgccggcgtcaaggtcttgccgcacatcatcaacgcctgcatcctggtctttgtcttttccgcctccaactctgacttgtacattgccagccgaactctctacggccttgcctccgatgacgctgctcccgccatcttcaagcgaaccaacaagcgtggtgttccctacccagcgcttttcctttgcgcagcgattgcctgcttggcatttatgaatgcttccaccgccagtacggtggtctttggctactttgtcaacctcgtcaccatcttcggtatcttgacttggatctccatccttgtcacctacctcttcttcctccgtgctcgtcgcgcccaaaacatccccgacagcgccatgccctatgtcgcccctcagggctactggggtaccatcgtctgcttgttcttcacgatcctcatcgccttgaccaagaactacgacgtcttcgtccacacccccgcccgcaagtttgactacaagaacttcatcactggatatcttggaatccctctctacctcatcatgctcttcggccacatgctcgttaccaagagcaagggtgtcaaggcccacgaggcggacttttacgctggaaaggaaattattgatgctcaggagaacgagtacctcgaggaacaagaggctaagcgtacgaacagccagggtatgcacaagttttacgatcgctacatctcgtggctgttttagattcgggggaataagtactcgggcaggtcgagatggtagactggggccctcatttatgtattactacgtggtatgaacatatgagtataataaaaaactcaatggatatgttgaaaaaaaaaaaaaaa

SEQ ID NO: 7404 - DNA, 523 bp, Nicotiana benthamiana
tgcatcttgactacccctcgacccacgcgtccgcccacgcgtccgcttcgattgtgttgggaagatggaactcaagcaatgcaagtcaaccgtctccctcaaactgagggtttctttcagcctctaggattgacttcttctcctcaatttggatacaatcatgtgggtacggatgaggtgaatggaggagcttcagctcataatatgaatgggtttattccagggtggatgctgtaaatctgataaatcaagacagctgctccatcttgcttcaacgaaataaaataatagtatattgcattttctttttgtttgttgcaacttgtatttagaaactctttaagtattattgggcacggacaataatatgcattcataagttactataacatttgaatggtcctgcttgattggccattatgtatttctgattgtattccatgtaactaaattgaattgttgtattatattagttgtatctttgaatcatatagatgtgttggctttgtacgccataaatttc

SEQ ID NO: 7405 - DNA, 683 bp, Nicotiana benthamiana
cccctcgacccacgcgtccgaattcacagggacatcaaggcttcaaacattttgttgagtgaggaatatgagccacagatatcagattttgggctagcaaaatggcttccatcacaatggacccatcattccattgttccaattgaagggacttttgggcacttagcaccagaatatttcatgcatggagtggttgatgaaaagacagatgtttttgcatttggggtgttctgcttggagctcatttctgggaaaaaaccagttgacaattcccatcaaagcatacacagctgggcaaaacctcttttgagcagaggagttatagaagaagtagtagatccaaggctagaaggcagatttgattcgacacaacttcataaacttgcttttgctgcttcactttgcattcgtgcttcttctatatggcgcccaaccatgaatgaggtgagagcttcaacagattatatacacactgtgtgacaattaatttcattgaaattaactacaatgttttttctttatctacaacattctcgtttctcatcgacgttcatggcattcatgaacttgcatttgatccagtctcaaacttcttgatgcttggtatctagttttacagtgttcgcgaacatagttctgaatttatatgtgattgcatgataatggttgggcttaaaaaaaaa

SEQ ID NO: 7406 - DNA, 1508 bp, Nicotiana benthamiana
cccctcgacccacgcgtccgccttagtacgagaggattagcaccatggcttcatcaaactttgtcaatttcaccatgttctttctatatcagtcttgtttgttaatgttctgcccagtgaattcaacatcaaggcatgctctgatcaacaaccataagggattcaaggtgagtctaaaacatgttgactcaggtgggaatttcaccaaattcgagcgtttacaacgcgcgatggcacgagggaaatcaagacttcaaaggttaaacctaatggctaataatttggtagcaacaacagccatagatgactctgacattgtaaagtctacaatccatgcaggaaatggtgagtttctcatgcaaatatccattggtagtccaaatgaaacctataatgttataatggatacaggaagtgacttaatttggactcaatgcaagccttgtaaagagtgttttgatcaatccacacctatttttgatccatcaaaatcatccactttttccaagatttcatgttctaacaaactttgtgaagcattgccaatgtcatcttgtggggataataattgtgaatatatgtacacatatggtgattattcatcaagtgaaggttttttagctagtgaaacattcagttttggcaaaaattctatcccaaatgttgcgtttggatgtggaaatgacaatcaaggcagtggatttagtcaaggtgcaggtctagttggactagggagaggtccattatcacttgtttctcaactccaaatgcccaaattttcctattgtttaacctcaattaatgttgatgctaatagcaaaattagcagcacattacttatgggaaccatagcaaatgatgattattccaatattatcacaaccccattagtgaaaaatccttcacaaccatctttttattatctttccttacaaggaatatcagttggagatactcgattacctatcaagaaatccacattttcactcaaccaagatggcagtggaggagtaataatagactctgggacaaccataacatacttagaagaaagtgcatttaaacttctcaagaaagagttctcttcacaggtaaaccttccggtggatgattccagctcaacaggactggatttatgcttcactttgccttcaaacacaaataatatataggttccaaaattggttttccattttgaaggtgcagacttggatttgcctactgacaattacatgattgctgattcaagtatgggagttgcttgtttggccatgggaggttcaagtggaatgtccatttttggaaatgttcagcaacaaaatatgcttgtcattcatgatctgaataaagagactttatcatttgtaccaacacaatgtgataaactgtagaatatatatatctccatttgtggttcaggtgttcatttatatgtctgttttctttttctattatctttctttagcaatatagaatttttatcatttcaatctaaaaaaaaaaaaaaa

SEQ ID NO: 7407 - DNA, 963 bp, Nicotiana benthamiana
cccctcgacccacgcgtccgcagaagagcaacatttgaacaagtatggaaaaggaaaacaaactaaaatcagagacttcattggaaaatccgatgttttcacaacagattcaaactgaaaaggattctttaggttttttagacaacatgtttggtgctcatcttcttgatttcaatactactattccttccattttcgatttgcttcaaacttcaccacctcaatcactgactaatattccatctccaacttccacatttcaagaatcatgtgaggtggaggtggtgaattcactgtcgatctcttcatcatcaactgaagctgccgaagatgatcagcagagtaatacagtaaagcaacaagatgaagatgaagacaagtataagaaacagttaaaacctaaaaagaagaatgttcaaaagaggcaaagagagccaagatttgcattcatgaccaagagcgaaattgatcatttggatgatggttttagatggaggaaatatggccaaaaagcagtgaaaaacagcccctttccaaggtatatatgtttaaaatatgacacatttttatatttgataattcattacgaagggagtacaattaaaatgtctctaggttaattcttctaccgtttaaactaataaaacacgctggtggatgcatatcatttataatatgtacatactgtactcatgtataattaatatataatctatatataccgattaagaaaaattgttagagttactgattgcagcccatcagcccaagttctggaccagactaagcagaccaactaagcagctaagttctggcccacacacacaatacatttatttcagcccggagtgtatatattctagacacgtctatattttatattgtggactgatatttcttgtaaagaacgacttatacacagaaatacatatagtcagttctctttcaaaaaaaaaaaaaaaa

SEQ ID NO: 7408 - DNA, 1151 bp, Poppy
gttcttgtcattaattaagtcgacgaattcaagaacatggtttgcgaaacttaccacgtctcttattcgaaaaggttttttatgttaattctcttcgtcttctttctcatctttatgatcggtggagatccagaaagtagacgcttgtgcagaagagaatttccagttggttatggcctgcgcctctattttcattgcgctttatttttgtccttgtatcttgttttacagttgtttcatctacacttgacagtgatgaacaacagatggttgttccaaatacccatgttgtggtaataaagtatcgaatttctggattctcatttcaacaaacatgttcttgtcaccttatcaacacaatcaaattccagtactagcaaaaaccagtcaatcttgggcttctagtgtaatgggccgtttaaatttctatttttttttactttttttttataaagtaagtgaagtaaccctcctacttcaacaaaatattccacttatggaactgttaaatgccaggataccaaaagcagaagttggtttttttttttttcttataaaagtcgttccgaaattatatacctataaactaatttactgtttgttaacttttagaagttaaaagaactatttcagggagtgtatcaaaaaacgccataaaaacaattctggaagtgtgtccaaacatgctataaatctaactattttttccttcttagcatgatttgcagaaggacgctggtaccacaagatttgccacattgtcaaaaaggtttttgcaacactcaaatcgactgtcaagagactttaccttagttttttgacactcaacttacaccacccaaatatgacttttggccaacccatttggcgaaaaaacaaagagttactaagacactaaacttagctcatcacagcacttcacattgctgctacatgtttatttgaaaacacaaaaagctgccaaggttatggtgaaaaagaactgtaatttgaccaaaatacaagataggagagggttcttacgtaccacattggattaattcacaaaatcttagtcttaaaacattggattctaatttctaaagacgtaaccatatttttacaaaatgaaaagaatggcgcttatccaaatgcttcaagaaaaaaaaaaa

SEQ ID NO: 7409 - DNA, 896 bp, Nicotiana benthamiana
cccctcgaggccattacggccgggccaactctcaccgaccagttcgcttgatgcaaattcaaatagcttcagtttggaaattggtaatggtgaatttagtggagctgaattgaagaaaattatggcaaatgagaaacttgcagagatagccttagcagatccaaagcgggccaaaaggattttagccaaccgccaatctgctgctcgttcaaaagagcgaaagatgagatacattgcggagttagaacacaaggtgcaaacactgcagactgaagccaccacattgtctgctcaactgacactgttgcagagagattctgctgggctaacgagccaaaaccacgagctgaagtttcgtttgcaagccatggagcagcaagctcaactccgtgatgcactaaatgaagcattaactgctgaagtacaacggttgaagcttgcaacctctgagataagtgcagacgctgcaaagtttcggcagctttctctcaatcctcagatgttccagttgcagcaacagcagccaactcagctaaacatgcatcagttgcagcagcaacaacaacaacatcaacaatcatctcagtctccacaacatgcacagcagcaacttaacagcgcaacgccttcaaagaacgaaacgaagtagtatcttttgggaatttctggtcatcgtaatatttatattagtttcttgatagatgttgcgagaagtactgtcattcaattgcattcattcattagttctgcattacaagaaaacacgctaaagacatggtatttatctataggacatgcatgctcgttggagtaattaagtcgcatagaatcttttgatgtatacagttcgtttttcacgtgataactcattttgttgttacgcaagttaaatgaaa

SEQ ID NO: 7410 - DNA, 1271 bp, Nicotiana benthamiana
cccctcgacccacgcgtccgcttgtctctcaatctgacccttttggccaattgaaatctgcatctgtggaacacactgagttgccaaaggggaatgcaactgagttcactattttctctgtatctccttcaggtgattggaaatcttcaggatatgggcaaaaccaatcaaacattcaggctgctgctacctcagttaatatggactatcgaagtcactttgagctagggtttagtcagtccctgatttctgcaaaatatccttacggaggacagcaatccgtcgggttattttcagcttatggtcctcaaatttcgggccgtgttatgctgccattgaatttggcctctgatgaaggcccgatattcgtaaacgccaagcagtatcatgggatactgaggcgtcgaaagtcccgggctaaggaaatggagaagaaagctcttaaaccacgcaagccatacttgcacctctctcgccatctccatgcaatgcgccgacctaggggctgtggtggacgcttcttgaacacaaggaaaatgaatggaactatgaagggtggaaaaaccaacgatacagttaagactggtgatgttcacagtttttacccaactggatcccagaattctgaagtgctgcagtctgatagtagcaatttaagctcacctaaagaaacgactggcagcaggttctgccattcgtcagaggtcactaacatgtactctaggggaaatcttgatccatttctgtttcaggacctgaggccttcggtccaggcaatacctgacacgatgaatactggacacggtattctcatggccggtaagtgggtttcagcagcagatagctgctgcaacctcaaagtttgatagccttggatgagaacggggttaggtgtcacgagttgtgcctgacctcgtctttgctgcaacctaatgcaaatgcattggaatttgatcttaccagcatttggttgcttgaaggcagtcatccttggctatcaatggggcagttcatccttggctagcgttaaggctgcctcctataattctattgctatcgagcaacatggatggtaagaggcgctccttaatgcactttaattttcagcacttgtaggataaataaacatattttggataagatgatgaagaccctgtcaatcggggctgtgatgttgcagtgtgtttggattactgttgtgatgtttgtttgtgaaaatacagtgatgtatgattgaacttgatccagataatgggcaacttggtggtttc

SEQ ID NO: 7411 - DNA, 603 bp, Nicotiana benthamiana
cccctcgacccacgcgtccccacgcgtccgctttccttttttattatagcattttttctttacaaatataaataaatcaaatagcaatcccaaaagaggcataacagttttgttttccgaaagagttttctctctatttctgtctaaagaagtcatggcggaaaaagggcgaccacttcctaagtttggagagtgggatgtaaatgacccagcttcagctgagggatttacagtgatctttaataaagctcgaaatgagaagaaaggtggtaagatagactcaccacctaaaggtgattctgcatacaagaataaagcaatgcttggaaaacctcaatcaaaaaaatggttttgctgtatgcaatctactgcggccgaatcatgaactgttttagctcctacatactgaactggaaagtgatgttggttggaaccagactctacgagtgacctataacactggagctgtagtcatgatctgacgaggaatactgggatttttgctgttgtattttggaatagttgctcaatttgcaggcttttgctgccaaaatattaatgatatatatttgtttgaaaaaaaaaaaaaaaaaaaaaaaaaaa

SEQ ID NO: 7412 - DNA, 1354 bp, Trichoderma harzianum
gttcttgtcattaattaactcgacccacgcgtccggcactcacccctccaacccctccaaagatctcaccaccggccgaaccctcctcgatctctgcgccgagaatcagctcctcctctccgaatccgtcgcttccaaatatggctccaagctgcccttcctcttcaaggtcctgtccatcaacaaggccctctccatccaggcccatcccaacaagaagctcgccgagcagctccacgcgcgggactccaaaaactaccccgatgacaaccacaagcccgagatggccattgcaatcaccccctttgagggactctgcggattcaggcctctgggagagattgcccacttcctggagacggtaaagccattgagaactctggtcggagagagcgaggcgtcgcagtttgtgcaggctgccaagcaagagggcggtgacgaggcggcaaagaagaaggccctgcagacggcattcggaggattgatgtcgtcctctgccgaagacgttgacagagaaactgctagcctcgttgcactcgccgagtctgagggcgccgacttcgctgccggtggtgtgtcatccaccaagggcgctgtcctcgccgagcttgtcactcgactcaacggccagtttggctccgacattggcattttcgtcctcttcttcctcaactttgtcacactacagcccggagaggcgctgttcctcgtcgccgatgacatccacgcctatgtctccggtgacattgtcgaatgcatggcagcgtccgacaatgtcgtccgtgctggtcttacacccaagttcaaggacgtatccaccctggttgacatgctcacctacaactatgcgcccatcgacgagcaaaagatgactcctaccgaatatccctatgcgactctgaaccgaaatgcctacagctccggatcttctgtcatgctgtacgatcctccgattgaggagtttagcgttgtgcgcactctgcttcgcggagagggggccaaggccactttcgaccccttggagggacccagcatcgtcatctgcaccggtggcaagggtacaatcgccgtgggaccgacaaaacaggagattcaggagggttacgtgtttttcgtcggatctaccgcggaattggtcctggaatccgccgtcggaaaggacgaggagtttaccacgttcaaggcattctgtgagattgatacatctggaaaatagaggctgcaatcatcttcttcaaatccttttccacattatcgaaagatgaacgaattcatgagcaattggaaattttggtagggcatataatacaaaacaagctagaactgaaaaaaaaaaaaaaaaaaaaaaaaaaaa

SEQ ID NO: 7413 - DNA, 1332 bp, Trichoderma harzianum
gcggtgacatcctaaccaaaaagaaacttgaccctcatcgtagccgctgtcgaggcgcaacctttacctgtattgattgcatggtatactttcccggcgtcgaatatcgttctcatacatcttgcatgacagaagagcagaaataccaaggcgcattgtataagccgaagcaaaacaacaagaagcagcagcaacagcagcaacatcatcagcaacaacagcccaccatgaactcgcatcggttaggcatggccaacacgttggccctgcagccatttgtcgaagatgtcaacgaagacaaggaatacgagtcgtggcacgagtacgaagacaagtctcgacctccccccgaggcgccaacccctccatctgccgccgacgatgaccacgtcaacgtctttgacttcctagacaactctcaaaccccgactgcctcaaacgtgagccatgcgcgagaccgaaaagctcctggtcccagcgacagcacctctcttgtgcgctacgagacaaagagcggagagctcctggagccggttattatggaccgagacggagagccgcttgtacaatacggaaccggccctgtacccacaggttctctcgccacccctcaacccaagaccgagcgacggaggtcaaaggaacgcgatgccaagaaggacaagaagcggaagcgcctgcacgtcgatgttactggcgaccaaatcatggctgatgcacctcccgttcttcactctggtctcactggtggcctgaagaacatgatgcggcctgccttcccaccctcacccgattactctggagacaacattgccgatctctccccaacaagcccgctcaagaagacgaagcactctcgacaccacaagagccaccattcccacacgatgagcaacagcctctttggcatgatttctggccctccacccaagaccaagtcgagcaagcacaagtcgtcttccaagaagcactcctctcacaggcatgagaagaaggagcccaagctcatcgagttccgacctggttccaaggacggcaaacatgagaacctcgacgggcagatgattgtctttaagccccgtgccgatgtcttcctcagcttcgtcaacaagggacctgagagtgagcgcggctgcagcatgaacaaggccttgaagcgattccaccgggagcgccaagccgccggctctagctcccccaagggcaaggaagagaaggaactgtggcgatctctgcgacttcgacgcaacgaccgaggcgaaattgttctcttttgtgaagaataaacagaaagaagaaatcaaacaaaaaaaaaacataacataaaaaaaa

SEQ ID NO: 7414 - DNA, 1471 bp, Trichoderma harzianum
cggacgcgtgggcggacgcgtgggcggacgcgtgggcgacatcagtcacaatggctttcggaactctcttcaccaccgccgaccaacctcgtgccgccgccatcaaggccgtcgccaaggccaacggcctcgagctcaacatctccaacgttgaggctggcaagcccactgctgagcacctcaaggctcaccctctgggcaaataccctgctttcctcggcgaggatggctttgccctgagcgagagcattgctatcgccatctacgtcacctcccagaacgagaagaccacccttctcggcaagaccaagcaggactacgcttccatcctccgatggatgtcctacttcaacaccgaggtttgccccaagatcggtgcttggatcaagcccctgaccggcgcctccccctacaacaagaaggctgtcgatgacatctccaaggaggttgcccgtgctgttgatgctgctgaggagcacctcactcaccacacctacctcgttggtgagcgcatcaccctggctgatctcttcagcgctggcctcctctaccgcggcttccagtacttcttcgacaagcagtggcgccagcagcaccccgctgttactcgatggtacgagaccattgttaaccagcccatctacactgccgtcgccgagaagctccccttcctggagactcccgtcctgaccaacactccccccaagaagcctgagcagcccaaggccgctcctaaggccgcccccgcccccaaggccgccgccgccgaggaggaggagcctgccgcccccaaggctaagcaccctcttgatgctctgcccaaggcttcccttcctctcgatgagtggaagcgccagtactccaacagcgagacccccgctgccctcgcctggttctgggagaacgtcaacttcgaggagtactccatctggaagtttgcctacaagtacaacgatgagcttgccatgaccttcatgtccaacaacctcatcggcggcttcaacaaccgtctcgagggctcccgcaagtacctcttcggatgcacctccgtctacggaaccaacaacgactccgtcattgagggtgctttcgtcatccgtggccaggagtacgtccctgtcttcgacgtcgctcccgactacgagagctacgagttcaccaagcttgaccctaccaagcctgaggaccgtgcctttgttgaggctcagtggtcttgggacaagcccgtcattgtcaacggcaaggagtaccctcacgccgacggccacgtcttcaaataaagaacgacagtggatgggggtgatgataaactatgaagtgatgatgggttatgggtaaaaaaagggttgaagggaatgaatgatgatatctcatgtgcttgtacacacacacatgcctacgtagtcttataaatcaaggccgcaggaaaccaattcaaaaccgtaaaaagcgattaaaaaaaaaaaaaaaa

SEQ ID NO: 7415 - DNA, 1268 bp, Trichoderma harzianum
gctgcttcgtaagatcaagcaagtgtacaatcatctcattctctatctacttattagtcatggggaaaagaagcgaaagtgaaagcggctcaaagccggagcgggaagaatctcacggcgcaccggctgagcttccgcaagaggtgatccctttcgacccggtgccgacatacgaagaatcgaggccagggccatcggattcggcctcactttccgtctcccattcactctctgccacagtctcggcatcaacaccgcagccgccggccggaacctcagccctggccccaaccgttacctcgccatttaatttccctaccgatggcaaaggcaaagacggctccgtgaatgctcctccaccagtctacaaggtcgggtcatccagtagcagctccagcgccgcccgaaccattgcctttcctcagatcaaaccagatccagactcgcctttcctggtggcctatgcccctgttcttctcagctatggcatcaccgaagaaacatggcggtctttcatgaccaccatctcggctttcctgacggccaccatctcagatcgtgccctatcacatgccaccgatgtagctgctcacattggccaaaatcccaaaaacttgggcagaaatgttgctgcccatgccaaatccatcggcaggaacgtgtcggacaatgccaaacggggcaacatcataggtgctgccatgggcctcatcggcggcaccatctctctaccaatatcaacggccctgggcgtcgtgggcaccactctttcgctccctggccaggccattggtgccgtgaccaagaggccgagaaccccccaagagagagccgcgacgtatgcggccgttgcaaacgaagagtggctgcacatgcgcggcttgcacgcacatctgtttgattccgccgggttggctcatcatttgggaatgccgctggatactttgttaagcttggcttgggagactaaagagagcgatgctggaagacagatgagggcactggagccgcatattgctgggctcgatgttgacgagggggcgatgttgcaactgaagacccaaacgctgtggctagtgttgatgcctggaaagcaaccctcttcaagttgaatacgactgcgggtggagtaatggttttcttattagtagggcaagggatatgggtacatgtagttgattcttttcaggacagatcagtgtccaaaactttggttatagaagcacaagcaatgaataatggaatttagaataaaaaaaaaaaaaaaa

SEQ ID NO: 7416 - DNA, 1326 bp, Trichoderma harzianum
cccacgcgtccgaagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcgtttgtccagatggctcacgagtgggcagtcaggcacgccggtgcgccgcgacagcgaaacctcgacgtaactatattcagaagcctggccagaccaacaactgctgtcgatgcgagccgataccatggatacaagccagtcttggtcgaacagtttacggcaatgggatttgacctcgataacgtggtggcgactctcgagtttttccgcatcgacaaattccatgaaaacctacctccgtctcgcatgtcggacgtaacaactcgacttcttggtgagcagccttaggaagcataagggaagtttaggagctaccaacctgcccccttcctaacatcgagtggcgaaatgaattggagtttatttacatggactgagggttgaatctcttttttcttgggtttctgtttcttcccctggggctctgtcctttggctcagttgtgctccaatgtcctgttcctgaaatttgtagactcgggatggacgggacagttgcttacgagagccgagtcacttattgaatggtggtgactagctggacacctgaatagtcatttagaagttcaggagagacgggtgtttagggcatcactggtgccccgggagcgcatgctatcaggtatacagcgactctggagttatcaaggtcggaattaggtagcatattacactcaatatagcggaaaaaaaaaaaaaaaaaa

SEQ ID NO: 7417 - DNA, 1165 bp, Trichoderma harzianum
agcacggagcaccaccatggcttcaaggttgaagatctggggtgcctgcaggactctggcggtccggacgcagcccgtccgccttgcggctcagccattccgaaaccaggtttcagcgactcgattctatgccgacgatgcgaccaacaaaccctccaattctccgagcggtgcaaagagagaagcttctagatcagtttctaaatcagaaccaacaagttccagggttactgagggcacctctggagaattgacccagaaagccgcacaagagacatcttcatcacaagcctcacccattgaagcgctagacgatgcgaccttggaacaaatactatatggcggtcgacccgtaacaagtcagcgggagggcggcttgacagaggcgcaagaggaggctctatatcgcgagggtgtcattcccccaccagagcaggcggaagctatcgttgctgccgggtcacagtcaatagtccctgttggctcagaagtgcaaaacgccggccataagtttggtcttcctcagaagccctatccggacgggttccatgtcaagaagcgataccaccccgtgctggagcaaatcactaggctcctgatgcgacatggagaactcagtgttgcgcaaagaaacatggctgctgtcatgaacttcttacgaacgtcgcccgcccctatctacagcccgaaattccccctattaccagggactccgcccgccgcccacctccctcttaaccccgtcctctacatcacaatcgccatcgactcggttgcgccgctcctaaaagtgaggaacattgccggcgctggtggaggtggccgtgctctggaactccccgtccccctcgccgtcagacagcgccgaagaatggcgttccaatggatcctggacgtcatcaacaagaagccctcgaaaggcagtgggcggaaccagtttgcccatcggatagctgaggagatcatcgccgtggtggagggcaggtcgagcgtctgggagaagagaaagctagttcacaagcttggcactgcggctagagccaacgtggggtccaacaagctgaagacgaagaagaagaaataaaggacatgatgcgacggcggatttgaatgtatattagatgtgtattctacggcagcgaactagatgacaaaaaaaaaaaaa

SEQ ID NO: 7418 - DNA, 1759 bp, Trichoderma harzianum
cccacgcgtccgcccacgcgtccgggatcttggtgggcaccacgacgttcttctccatcctcatcttctcgatcaacactgtctttgctcaggaaacactcgcgcagtggattggagattacctgactcaatctgctggtgttacggttgtcttcgaatcagccatagtgcccaagtggaagaatggcgttatcgcatttcgtaatgtgtttatttcaagaagacccgggcagatcgaatcatccgtcagcaagggatcgtctgacgctgctgctgttgctgccgcagggcgccaggttcagcataacgggactgttaccgaagacgatggcaactatacgcaatttgatgtaacgatcgcaaacgtcaatgtcacactttcattcctcaactggtggaatggcagggggcttctcaaagatgtggaagtaaatggtgttagaggaattgtcgatcgcacctctgtccgttggccactgcagcaaatcgaccccttgtcttaccgccacaaacaccaaccaggcgattttgagattgaatctttcaaattggaagatcttttgctcaccattcgccaacctgatggcttccgccccttctcagtgagcatatactcctgcgaactccctcgactgagaaaacaatggctcttttatgatttcctatctgccagccatatgtctgggtcatttgatggctctctctttacaattcatccgcgacaagttcacggtacggtttcaagtcgataccagggagtcatgatggggctagaggaatccaagtcgtggaaaaaattcaaccggctacggattgatggcttgaagattgaccacctaaaccgtggagtggagggcccatttggctggatctatgaaggaaacgttgacatcgttgctgatgtcatgtttcccgaggatatggacgacagcattaccaaggtcgtaacggatttctacgaccagctggaaggcacagttattgctaatcgttatcgctttctgccccgagcccctacacccgagaaattctcagagagcgagcgcgcaacgagcgagaagaaggctcagaaacaagccaacgagtctgaggaggatagacgccttgtcatcatggacttgcgtattcatctcaatgacgtcaaggctgccgtgcctttattcacccccgatctgtcatatgtcaaccaggcgcttgttcgccccattgtggcctatatcaatgctaagaagacgtacattcccatctctagccgcatcatcaagccgctaagcgactttgacggaagttggacagtctttgattgcgggctcttggatgatgcatctgccgagacgtatgaggcttttgcaaaagatgtcgaagatcagcaaagccgcgtcaggcgattccgaaaggttggattctggactttgtcgctggccattcatgctctattcatgggaatggccgggaatgtggtttaaggggagaagacatggagaagaaaaaagggacggtggtggattcctgtagaattgctgtatatttacaacgacatgatgggacgggcggtacatgacgggatttttatgatggcgttgcgttgttacacgggtatcactccgggcatttcttggcgattttgggggtttttatggatctttatgagaaatacttgacgcttcaggagaggctatctatatctgataccctgacctcttgtctactgaagcagtgcaatacaaaacaaaaccactcccaaaaaaaaaaaaaaaaa

SEQ ID NO: 7419 - DNA, 1943 bp, Trichoderma harzianum
cgcgcttgcgttgcgtgtacctccgtgaagcaaaaatgcatgctacatcggcccaacatgtgccagagatgcgaacgccttggcaaagaatgtgtctttctcgagttgtcacaacggaagcgcaagcgcagcgagtctcggcgcgtggaaaagcttgaaaacacagttaatcagctgattacgcacttgacaggcctgacaggacaggatgtaacaccgctagcatcaccctcccgaacaacacagtccgtgatttcttctgccgagggcatgttggctatccaaagagatagttctctttcacaatcaggggacctacaagaccgcagtccagagcccgtaattggacatgagagtgtttgctctattgttttggaagctctcaataacgatgaaacagaggcgctccttcagaaattccaacaaaaattcgtacctatttttcctttcgcggcgatttctatatacaaaggctcgtatcacatcaggcatctaaacccttttctgttcctgtgcatcatggccgtaactataggaccaaagcatcctttacgggcgcatgtgcaacatgaagtcgtgaatcagggcatccgccgaatgatgctcggattggagagaaaccttgacctcctccgcggatttcttgtcttagccagctggtgtcacctcttcccgttttcccacagctctcgccccgatgtcttgaatctcgttcagatgtgcattacactttgctacacgctcaaccttgaacataaagcaaaattaacgccagaagagcaaagggctctactaggaacctactggatatcgaaatgcgccgagaaggctttcagcaagccgataggattgaagtatggagatgccattaaaaacgcctgcaaatccttaagtgaattatcggagtatccacatgatcgcgatattcaaccgcgaatcgcttcaagattcttaattggtcgaatctgcgaggcttttacatcccttcgcagtaaacaggcatcggacatatgggatgcaccggttggattaatgcgctgcctctttaagcgagaattggacgtcatcgagataggcgtgaatcagcaacagaatcttacccagccactgggcagcctcaacggacacttggcgagattggatatccattatgtgagcatatgtatgggagaatgtgcggttcatagccaacaaccatggctgcattgcatcgattctgatcccccgagcattaccgacaatatcacttttggctgttcagctgagagaatcgccataatttacaagacgatgagagcgtgcaaactttttatcctgggctttttagaaataccgagagctgacctgacttatgttacattcgttacgtattctcagctatgtttcactctgactacatatgccaaattggtgttggcacttttggaaatcgttgttggtgaagcagcatacgatgatcgtacggcatcggtaaccctaacagatgatcaaaattcacaatgcgcggctatagttgatgaggcagactatcttggattcctcgagttactgctgaagaaggttggaaaagcggctgaagagaatatggatgcgcaagagcgagggacagactttgtctcggtctttacctcaaagttaagactattcgctctcagttatccaactcgagtcaatggaatccttaggactgatttccttgacacaccgcgcgatgcagagtatacaggggagattcccagccataaaataactccttatcaatttgatcagggagctgatgataaacttgaacactggctacgaaggaataatgctactcaagaataccccaagcttccagatgatttgttatggaactctttctttactgattttgatataaataatctgctaaataagtcagattatattaataatatataaatcacttgaaaaaaaaaaaa

SEQ ID NO: 7420 - DNA, 764 bp, Trichoderma harzianum
tgataatagtcaaagaccaaatctcttctacggacattgagacgatatcaatgagccgagacaaaatggaaaaagcggaagcactaacgattcaactctttcttctccttggcgctgccctagtgtccatcggcggacgattatacgcccgatggcggcaggtcggaatgaagaatcttggtcttgatgatgggcttgccattacaggagtgattctctttgtgcccaatgtggtcttggcatacatgatgaacacgcggacccattggatgggcaatcattctgtcggcaacaatactacaacacagccgagccataacgaagatcaaatgagggaactgggatcgaaactctatctatacagctggttatcctattccgctgcattatggacgttcaaggcagcctttctcgcaaatgtccttcgtcgaattcccgaatccggcagacgacaaacccaccagtatctcggctttggcttcctggctgcaacatgggtagcaacgacgatggctctccctccaaagctgtcgaccgttgccccacatgtggcaggtttatcccagcccaggactgtactgccagcctgctacttcaccggtgctggcgtgggtttacttcagcttcgatatcgttacaaacctctatctagcgtctgcagctactcctgtcgctactagaaaagacaaacccacatgggaaaagcttcagtgggtcgcaacgcttgtttgcgggcttctagccacggcggccgcgtcgagggg

SEQ ID NO: 7421 - DNA, 1498 bp, Trichoderma harzianum
gcagaatgtcccgcgccgggtctgaggccaaaatgggaagaccttcgatcagactcatctcgtcatacatcttcgactggattgttctcatcgtggttgctggagtcggttatgtcctcggtgttatcacgcccaacaagcggcccttttctctggtgaatccagacatctctttcccttttacagaacatgagaccgtcccagactggctgctctttgtcttgagctgcggtgtccctgccgtcatcatcgtcattgtctccatcatctttgtacctggagcaacagtacccaagaacacccctgcttcactgatatggaaacgtaagctatgggagcttcacaccggtcttctggggctcctaatgtccgttgcctgtggcttcttcttcgtcagcggtatcaagaacatgtgtggcaagcctcgacctgatctcctcgcacgatgcctgccagacctggagaacgcttccaagttcctgattggcggtttccaaggagagtccaagttgggcaacagcattggccagctctattcggcagacatctgccagcagaccgacaaggcgaagctcaacgacggcttccgaagctatcccagtggccactctgccgcctctgcgggtggcctcctctatctttcactcttccttgccagtaaatttgccgtaactatgccatttgtggcgacgagcacctcttcatccagccacgacgtacatgctgcattcccttctcgcctgggatccgcagttgaacaatacgacgacgaggcatccgctcccatgacgggcaaaggcgccaattcaagcatcgcatataactccagcgtccagtccttgcgtcgtcaggcagcagctccccccgtctatctcctggtcattactgtggcaccattctgcctcgccatattcatagcagcctcccgctggtttgatttccgacatcacggttttgatattttgtttggcttttgcattggtgtttttactgccattttcagctttaggttttatcacctgcccattactgtcggagctggttgggcgtggggtcctcgcagtccagatagggctttctgggctggcgttggacgactgggctatgtgggtgaaaaggatgttgagcgtgggatgaccgttcccgccaattatggagcgtccacggatgtcgaggcgcacggggcttctctttcagtgcccgcagctatgagctacaggtcgccggtttcgaggaatgacccctaccaggatgtcgaattacacaacttgaacgaggggacgagccaaggggcacagcacgggaattgattcgagagtttttaaatgatacccatctcccagcgaggagattgcacttagaaaacgtggcggaggccctcgaaggagaaaatggtctttgttttgttcttcatcttctgccttgtcgaagggtcatgtatatgtcaggaatagctgtgcactaatatttaaacataagttccgtcaaaaaaaaaaaa

SEQ ID NO: 7422 - DNA, 1865 bp, Trichoderma harzianum
gttgaacggaaggaagtagccaatccgtcaactccagacacaatctctgccctcctctggcctcacaatgtccgccatctcccgcagcatcagatcagcatccaagctgcgagtccagtcgcgagccgcaagtggtctctgctcggcctccatcggcgccgctcgctttgtctcgtccggctttgctgtgccttcaacccccgcctcgcgcagcaacttctcgacttccattcccaagctttctggagcgcccatcatgtcttcctcgcgcgagtacgatcctgagatcaaggacattgccgactatgtcgccaacaagacaattgactctgagctagcttttgacactgctcgatggattctcctcgacaccctcggctgcggtcttgagggcctccgcttcaaggagtgcgccaagctgctgggcccgattgtccctggcaccgtcgtgcccaacggcacaaaggttcccggcactccctttgtgctggatcccgtcaacggagccttcaacattggcgccatgatccgatggctcgacttcaacgactgctggctggccgccgaatggggccacccctctgacaacctgggtgccatcctggctgttgctgactggatcaaccgcaccaacaaggccggcggcaacctggctggcggcaagatcttcaccatccgagacgtgctcgagggcatgatcaaggcccacgagatccagggctgcttggccctgctcaactcgtacaacaaggtcggtctcgaccacgttgtcctggtcaaggtcgcctccaccgccgtggtctccaagatgctgggcctcagcgagaagcagattgccgatgccgtgacccaggcctgggttgacggccagagcctgcgaacctaccgccacagccccaacaccatgtcccgcaagtcctgggctgccggtgatgcctgccagcgcgccgtcaacctggccctcaaggtcatgaagggcgagtctggtattcccaccgttctgtctgctcccacctggggtttctacgatgtcctgttcaagggcaagaagtttgagttccagcgcccctacggcagctacgtcatggagaacgtcctcttcaaggtctcctaccctgccgagttccactcccagaccgccgtcgaggcctctgagaagatccaccaccagctcaaggccatgggcaagtccgccgccgacatcaaggccgtcacctgccgaacccacgaggcctgcatccgcatcatcgacaagcagttcaagcccatggacaacttcgccgaccgtgaccactgcatccagtacatggcctccgtcatgctcgtcttcggccgcctcgaggccaccgactacgtcgacggctctgaggctgctacttcggagcttgtcgagtctctgcgcaagaagatcaagtgcgttgaggacccccagtacactcaggactaccatgaccctgccctgcgaaccatctccaacgccctgaccgttgagctcaacgacggcaccgtcctcgaggaggtcgctgttgaggctcctctgggccaccgtcttcgtcgtgaggaggccaagcccgtcatcctggccaagtacaagcgccacctggctcctcacttccctgaggccaccgtcaacgagctcgttgagctcagccaggacagcaagaagctcgaggccatgaccgtggacgagtacgttgacaagtacgctgtcaaggagagcaagtttgttgtttaaattggggttgtgcaaaagtagaagaaaatcctgatgtacctagatgtttatgatgacggtcatatagaccaaacaaaagtagcattatattaatgaaagaaaaaaaaaagagtataaatgaaaaaaaaaa

SEQ ID NO: 7423 - DNA, 1450 bp, Trichoderma harzianum
caatcattcatccatcctccatcccatcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagtcccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattaccatcggtactccccctcagaccttcaaggttgtccttgacactggaagctccaacctttgggttccctcccagtcgtgcaacagcattgcctgcttcctgcattccacgtacgattcgtcctcctcgaagacgtacaagcagaatggatccgacttcgagatccactacggatcaggcagcttgactggcttcatctccaatgatgtcgtcaccattggtgacctcaagatcgagaagcaggactttgccgaggctaccagcgagcccggccttgcctttgctttcggtcgcttcgacggcattcttggccttggttacgataccatttccgtgaatggcatcgttccccccttctaccagatggtcaagcagaagcttattgacgagcccgtctttgctttctacttgggaagcagcgacgagggttccgaggccgtcttcggtggtgtcgatgaatctcactacgagggaaagattgagtacattcctctccgccgcaaggcctactgggaggtggacctcgacgccattgctttcggtgaccaggaagctgagcttgagaacactggtgccatcctcgacaccggtacttctctcaacgttcttccctctgaccttgccgagcttctcaatgcccagatcggtgccaagaagggcttcggcggccagtacactgtcgactgctccaagcgtgattcccttcccgacatcaccttcactctggctggttccaagtacagcctccctgctaccgactacatcatcgagatgcaaggtagctgcatttcttccttccagggcatggatttccccgcccccgtgggccctcttgttattcttggcgatgctttcttgcgccgctactactctgtctacgatctcggcaagaacgccgtcggtcttgccaaggccaaataaatcaacaggacgtgctggaattgggtgtatctaagatgagcactgcttgtgtgttggcagaagccagttttggttattttgggcagctttgagtgcagcaatacagtattgcggggagtatggatcaagactgcaacgtcatttatgtaatataatggatactattagctcaaaaaaaaaaaaaaa

SEQ ID NO: 7424 - DNA, 1179 bp, Trichoderma harzianum
cccacgcgtccgcccacgcgtccgcccacgcgtccgcccacgcgtccgatgtattcagacggccaatcaccgaaacagcacaaataagaatataagcaattattggtatgatattgcaagctacatgagtcaaacatcataaagcacctaagatacagagagtgaaatttaagctgcctgcttcgtcagagcttcgctaatacgccagagcttttctgcctgtgcgggatcaacagccccaggcaacaagccctcttttgtcaagactccgtcggccaagtagtagccatccttgtctgacaaaatgtgttagtatttgattaggttacatgagtgaagttgaggtataggaatgctgggatacactgggtgtgacgtactggacagtcgagagtcgaaagcggcgataattccagttgaggatccctcagccaaggtcttggccttaatcgccgagttcaggttaccgttgtcatcgatccagcctatcgcatattagcattgtgacaaattcagaaagacaagcaatgaacagtaggatcaacgctgaaagagcgcaatccccgctggccaaagtgctggaccaagccgactgacaagagaacatcgcatgccttggaattgctgtaagccgtccacttctcatagtctttgccgttgttgtatgaaaggtcgtccaagaaggacagattggcgcgggattgagcttcgcttgagtaagtcacaacgacgccgtgctccgaggcgagcagcttctcaatcaataaattgatgaagagaaagtgacccaggtggttaacagcgaattgcatctcaatatcgtccttggacttctcaaatgatggcacagccatgacgccggcggtacagatcatggcatcaagaaccgtaacagagctgtttacctcggcggcagccttgcgggtggtttccaatgaggagagatcgagcacgatgggctgcacgacggtgcctttagggatgtctagggacttgatcacctcttgtagcttgtctgccgctcgactggcgatgagaagtttggccggcttctgagccaggatagctcgagctgtgtcggaacccagtgaattcgggctgacaccggtcacaagaactaaatgctagaaattagcaaagcaaatgctgaagaagaaagggcaaaaatgaaaaaaaaaa

SEQ ID NO: 7425 - DNA, 1905 bp, Trichoderma harzianum
ctgcatgtcttggacctgcctctcatcatctcatctccctcttgtttgaagaagagagatcttgtctcttcccacctctcacagtttgaagctgtgcattgttcaacagcaacaaaaacatcatgtcagacgacggccacgaaaaggcgaaactcgagtctcacatagactttgtttccaccgcgccagactcacaagatgtcaacgccttcatcgatgacatggagggccagctcgaggcttctggaggtctcaagacgggcttcttccatgtgcagttcagcgacccgcggcactttacatggctgctcgtcgcctttgccagcatgggcggcctgctgtctggcctggaccagagcttgatctctggcgccaatctgttcttgcccaaggacttggacttgacggagaggcagaacagtttggtgaattcgggtatgccgttgggtgctgtgggaggcgccttgttgctgtcgcctgcgaatgagtactgtggacgcaagtgggcgattatcatctccatcctgctgtatactgttggtgctgcgctggaagctggctccatcagctttggtatgattgtttctggtcgtgtcattctgggtcttggtgtcggcctcgagggcggcactgtccccgtctatgtcgccgagactgtcgagcgccgtatccgaggcaacctcgtctcgctctaccagtttaacattgcgcttggagaagtccttggatatgctgtggcggccatcttcctcaaggttccaggcaactggcgctatatcctgggttcatcgcttctattctccaccatcatgtttgttggaatgctgttcctgccagagagtcctcgcttcctcatgcacaagaacagaattctagattcctacaaggtctggaagcgcatccgtggcacagagtcccccgaatctcgcgaggagttttacatcatggccaattccgtccagcaggagaacacggaagtcagcgaaggtgccaagaacacacggttcccttggatggactttttcactgttcctcgcgctcgccgtgctctcgtttacgcaaacatgatgattctccttggacagctgacgggtgtgaatgccatcatgtactacatgtccgtcctcatgaaccagatcggcttcgacgacgaaaaggctacatacatgtctcttgtcggaggcggatccttgctcatcggaacaattcctgctattttcctgatggaaacttgtggcagacgattttgggccatcacaatgcttccgggcttctttattggcctggtgttgattggcgtggcgtatcaaattcccatcgataccaacctgcaggcggctgaggggctctatctcagcggtctcatcatctacatgatgttctttggctcttatgcatgcttaacatgggttgtcccgtctgaagtgtacccaacctacctccgaagttatggcatgaccacctcagatgctctcctcttcctcgcctcctttatcgtgacatacaactttacagccatggaagacgccatgacccgcaccggcctgacgctgggcttctacggcggaattgcttttgtcggtgagatttaccaaatcttcttcatgcctgagacaaaggacaagactcttgaagagattgacgcagtcttctcgcgccctacctcagagattgtgcgtgagaattgggagggcgtcaaggaaactgtggcggatgtgtgcaacctccgtttccgcaaggtgtttgagggacagatgcagcggaggaagagccttcacgagcctgtgactgcttaattgggatgaggactgggtaataacgactatttggatatggatatacggatatagtgcagggctctgtatatgaatatgatgaattgatgtctgaaaaaaaaaaaaaaaa

SEQ ID NO: 7426 - DNA, 1354 bp, Trichoderma harzianum
caaaaagcccaccaacatggcgacaatgtcaaatcagtcgctgagggcggctgttcggtcggttggacgattaaatggacggacggctaggtcttcgggccttacatcgaggcaattcagcacctcgccagctcatggcgtcagggctgtcttcgccgagacggacaacaccgaaatgaacaagatcctcaacaccatccaagaaaacatcatcctccccgcctacctccccgaaaagcagcgcaggctcgtctttgaccccaagatgaagtcctacctcgagcaaaaccccatcatcatcgaggtcgagggcctcgaacacaaattctcctccatcgaccacttcaccggtatcgaaaactcaaagacgatcctctccgaggccctcagcagcatgaagagccaggacgactgggccaacctgggaaccctcctggcggggtacaagaaggcggggatacggctcaaggcaaaccactgggggaagattgtgcgcatggcaggcaagagcggcaacattcacgccgtcattgagtgcgcgaagcagtctgacaagacgggcctcctgttcaccaaccgagagacggtggtacgggtgctctcttacatcaatgaaaaggtcagcggcagcaattgggacgagaccgagacgaagcaggcgcagaagtgggcggatcaggtccttgatcttatccagcgcagagaacacacagtcgagggccagcctacacgagaaagactacacttttctcgcgttgtacgtggaatgactctcttcacgagggcatccgccatcaaggtcaagcaggcagcgggcgaagccgtcgagcaagacattttgctcctcaaggacgaggtcgaactgctcagctctctgtggaaagactcaacgaatgccaacctggaggaagtagccgaattcgcaaagctcaaccctacactggagagaaactccagccccaagggcgtcaagattcccaccgccctgaacggaagcgcatacgtgcaggttctggcacagaacatcaagggtattgcgctcgcgcgcgagattgttggggaggaggcccagggccttgcgccggtggaagtcgctctggccgatcacctgcggcactttgttcagaccagcaagagcccgacgaatggctgggaccaggaatattcaaaaatcgtcggagaagcacccaagtggtgaactttactgtacaaaaaaagagggggaaaggggggagagatgggaaacaaccggggactacacaaaagagaagaaaaagaaagggataaagtctatatatgtatgatatatacgtgtaccatataaaacaaaaataacaatttcaaaaaaaaaaaa

SEQ ID NO: 7427 - DNA, 846 bp, Trichoderma harzianum
aagaaggaatacaagactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacgtcggcaaggccaagggcacatcttggaggatgaacttcttccgaaccgtcgtcagccctgagatttaccctaatcagactcttggtggatggtcgccgccagaccaggcgagcttccatattacaaagttctttggtcatgtcaagtttatttgatcgggaggatttgggtttacgattgatgtttgcgagccgtaaagcggaattacaaagcacatgtacataatgcggcatgcctgatctaatgtaattgtcaatgatgaatgatctgacaaaaagaaaaaaaaaa

SEQ ID NO: 7428 - DNA, 1543 bp, Trichoderma harzianum
agaccatgaccgtgcaagccgagcccaaggtgcccatggacgccctggctgcccacactctcaagcacggtgtcattccaaagattgtcatggaattcaagggcatcactgttggtggtggctactctggcttttccggcgagagcagcatgtaccgctatggcctcttcaacaataccgtctccgagattgagattgtgcttggcgacggcacgctggaaacggccaaccgcgagcacaatgcggatctgctggagcacgctgctggcagcttgggcacgtttggcattgtcaccctgctcaccattgagctgattccggccactacctacgtcaagctggacgtccagctggtcaacgacgttgccaccgcccacgacttgtttgaggaggccaccaaggacgagtcgatccacttcattgatggagtctacttccgcaagggcacaattgccgtcatgtttggccgttttgtcaacgtcctcccccagggcaggtctgctcttaagaagatggaggttcactggtttgccgataccattgaggacgctctcaagaagaagcccaccgccgagaaacccatagacatctacatgttcacacccgactatctcttccgctatgaccatggcgccttctggggtggcaagctcgcctttaagcacttccacgtgcctgagaatgccttcaccaagcgcctggcggaccccttcctggacagccgcacgtgctaccatgcgctgcacaagtccggccttgccaacgagtatgtcgtgcaagattttggcattccagcgagcacggtcaaggaattcattagctttgtcaatgataccctgccggagctcatgatcttcttggctccttgcaaggcccccaaggagattggcctgacatctcgtttcaacgcccgcgtcgacgaagtttcggaccaacgcatctttgccgttggcgtctacggccgcggacctcgtgacccaaaggcgttttacgaactcaaccgcaagctcgagctgcgaagcgccgagctcatgggtgccaagctcctgtacgctcgaacttactacaccgaggacgagttctggctcatctaccgcaaggacgtctacgacgagatgcgcaagaagtacaaggccgagacactgccttccgtctacgacaagctcaaggcggacatggagaccggtgcgggcaagcgaaggcctgtgcgtggcatcatcgaaacaatgtgggacaaggccatgggcaacaaggcctacatccctgtgaagaaatgaagctttctcataatgccaaggggacgattgattgcgtgacatgttggatatgtctacctacctaattacagcgctttgtcagcctgtgtgatagatacccctgactttcttcctttgagctctccaagtaagagcgtttttttttctttctctaatttagttttccgatggaatacttttcaatgataccaagacagttctcgtctattgcattccatagaataaagacctaaatttacatttgcctctttgttaaaaaaaaaaaa

SEQ ID NO: 7429 - DNA, 1487 bp, Trichoderma harzianum
acgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcgaggaggacgttgggaatctgctttctgctattgacggtgtttctatggacgctgtccaactttctcgccagctttatcttttccgatgcaacctacgataagcccttcttcctcgtctacttcaacacctccatgttcgccatctctttaatacccatgtttgtacgatatctgctccagaaaggattccatggcctacgaagcgacgtcaggcgcatgtgggcggagcatcgataccaagccgccccaggcagtcccgcgatagatgaagaagatcacctagctcaagaacgcttgctagtagacgaacgagaccccatggcaccaacctcgactccttcaaaagagaagctcagcttccgagaaaccgcagtactgagccttgagttctgcatgttgtggttcctcgcaaactattttgcgtctgcatgtctcgagtataccagcgtcgccagcgtcacgattctcacgtccacgagcagcgtctggacactagtgtttggctccatgttcggcgtcgagaccttttccctgcgtaagctggttggagttgtggcgtctcttaccggcatcatactcatctccatggtggacctctcaggcaagagtgacgagaacagaggatcgttcccgcacaagactcccgggcagatcgcgctcggagatgccatggcgtttttgagcgctgtggtttacggcatatatgtcactgttatgaagcgacgagtgggtgatgaggacaaggtcaacatgcagctattctttgggttggtaggagtgtttaatctggccctactatggccgctcttcttcatcctccactggacgggtctcgaaccgttcgagctaccccctacgagccagatttggaccatcattatagtaaacgcaattgcgtcctttgtcagtgatatatcctgggcactggccatgctcctgacgacgccgttggtcgtcaccgtgggcctgtctctgaccatcccgctctccctcattggcgagatgatccagtaccagcagtactccagcggcgtttactgggtcggcgcggccgttgtctttgtctcatttgtttttgttaatcacgagacaaaggaggaggacacgagcaaggcggtaaacgtcacagcaggtctcagttcggcttccgaccctgatggtgccgacggaggtgcgggctatggacgattgtaatgaattgcatgtagatttggagggtttttcatcacctttttgcgcttcttcaacaggcgcgtcgtaacatctctcttattagaatgaattccaatagatgtttcgtaaaaaaaaaaaaa

SEQ ID NO: 7430 - DNA, 895 bp, Trichoderma harzianum
acagaagcagttaactacttatacagctactatataagctttccaaccaacccctcacctgtcgcctcaacctcatacgactcatcatcctattcctccttcaacaatttcaattcatttcacaactctcagtcaagatgcaactcttcgccgtctttgccgctgccactacacttattgccggctccaacgccctcttcatcccccgcaacatccacgtcgcagacttccgcctctacagcgccgagggctgccacgacggcaacctcggcgtctggaccgtcattgatgacgacttcaagaatggcgaatgcaagggcctcaacgatagtgagcccaagtctctgagcctgacagacattaacaagggctgcacattcacggcttacaccgacgacaagtgcaccaagggcaagaaggatttcacaaagggacattgcttcgacaacaaggccggctggaaagcctggagcatgaagtgcgactacaaggactaaaagggtcctccctaccttcttttttttcctcaccgcaactttgccagcaccatttattttcatcacttttttttccattccttacatcatggtggagtttcacgtttttttgaatcaggattacactggactgatttgtgggaaccgggacatgaacacaacaagcatattgattgacacggaacgcattatggggttatcgggctggccattttccaggatcacggcttttgggtaataatgggtaacggttgttatgacacggtccttttatgatgatgcatgcatgtacacatacattatacaatattgatggccaatccatcaataataattagttaatgagataataacagcgccagcgaggcaaaataaccattgataaaaaaaaaaaaaaa

SEQ ID NO: 7431 - DNA, 1332 bp, Trichoderma harzianum
ggccaaatgagattcttttctatttcgagccccaagcagagctcattcgttagcatcttgctacctacaccctgcatgcgcatacgcgatgaatgggcacccggtctgtctgcactctcgtaccctctgctcaaacaagcgagaaacagacgcctctgtcgtctcactcgctgcgccagcgccttggcctgggtaaagcggctgggtaatgcaatccggcgcaacggcctttgccatgtctggaacgcaatgctacgcaagtaacagtaatgcctgcgtttggtgcaggtcgtcgctcgccaccgctggctggctgacagccggcagtgccgcagacacgtataatgatcccactccaatacgtacagagacaactggcacacacccccaggcctgaacgagagacttggatctgggagcgagcaaattgatctgatgctggctagcacgtactacccgacttgacttgctaccatgttgatactgtatgcctcgcctcgccttgcacgaaccatctcatcgcaagtctgatccgacgtggagctaagcctaccatggcaaccgcggccacacatacaacacgttaggcttgtgacgatgcaagggagatggctctgccacggttggccatgtatcaacgttagcacgttctgtgagtgacgagcatctcccttgcccgagacacctggttcgacactgccgtgaggtacgcagtctgttccagattgatctcccgcggctacataatccctagcgaaggtggcccccccccaccacttggcgctgctgctcactgccaatccaataaggcagctctcacgctgaggcatcttgcacacacaaaaaccggatgaatcatctgaccagtgccaccggaatgggggagatgcaacagtcgtgcggccagaaaataagggcccccaaagcagactctttttgttgtttggaggctggctggcctgagacgatctggcagaccaacaacgagacaagggctttgccggcggttagaccccagtgatgagattcgcaaacaggcgcgcccgctgggagacggcccccagctgattgattgatacctggtagtacatgggcagttggagtactcgtatggacaaagtaccgtaccggtactcggggcttgtaagacggctctctggaggggaatacgagctggcaaaacattaaaaggcaaggctcagggcgggctgtaagccgcagcgcagtggctctttttaagttgtcggggagatagatggccacagccgttctggggaccacgacggcaaaggaattgagagaaaatagtctaaaaaaaaaaaaaaaaaaaaa

SEQ ID NO: 7432 - DNA, 1395 bp, Trichoderma harzianum
actcacaatattggtttagcatttcaaaaccggcatcatggcggacgcagatttcaatcctgactctgtcaacctcacagctattgttgatcaagatggagacatcagagacatcatctgctttctcaatgctggcgacaacgactacaatggacagcttggtgcacgtgtttcggctctattcgtcatccttgtcatttcatcggcagccaccctgttccccgtcctggccactcgtgtccggcgtctacgaatcccgctctatgtctatctctttgcccgatactttggctccggagtcatcattgctactgccttcatccatctcctcgaccctgcctatgaggagattggaccggctagctgcgtcggcttgactagtggctgggctgaatacacatggccccctgcactggctctgacttcggccatgctcatcttcctgctggatttcttggccgagtactacgtcgagaggaagtacaagctggcacatgtcgaagtcgaaggcacaattacatcggatcctactgtccctcatactcatcaaggacttcactcggctgaccaggatggtgcaattccccctttcaaccagaagcctgaagagcacagccacgcttctagcgataagctcgcttcaagcgataatctcgatgtggaagagctcaagcacctcgatggcgagtccaaggaatctgccatgggcttcgagtctcagatcgctgcattcttgattctcgaattcggtgtcatcttccacagtgtcatcatcggcctcaacctcggcgtcgtcggtgaagaattcaagaccctgtaccctgtcatcgtcttccaccaagccttcgagggcctgggtattggcgctcgcctgagtgtcattcccttccccaagcgcttcagatggatgccctgggctctctgcctggcctacggcttgacaacccccatcgctattgccattggcctcggtgtgcgaactacctacaacagtggttccttcactgccaatgtcgtgtctggtgtcctcgacgctatttctgccggtatcctcatctacaccggtttcgtcgagatgattgcgcgcgacttcctcttcaaccctcaccgcacacaggataagaagcgactgacatttatgctggtctctctctacctcggaatcatcatcatggccctgctgggtaagtgggcctaaggacgacatgtaggggaacgtgtaggatacgggtttgagatatataaaaaaagggaacaaggaaacggaaaagatacccgggcggaccattagaatgcgcacatgcgcataatcatgcagaatctgtgagatacacatctacataggaatgcattcttagaatgcaacaggacattacgaactttaaaaaaaaaaaa

SEQ ID NO: 7433 - DNA, 1802 bp, Trichoderma harzianum
cccacgcgtccgaaaggagagcaagacaaaacaaagtaaatcaaatctgtcgtggttacattgcatggtttactttgtacgcactgtcggatcggctggatgcttggcagcttttgcggcgcggcgtcatcaatgaaatattcatctctcaatccaggcacgcgagctcttttcgagatttccctggaaaagccacacaaagaaaggcaatctaggtgttgactaagcttctagataagagcttcacttcatcttctacgtcttacacaatatcgcatcccacctcttctatcaccatgccgatgcataagggcttcctgccgcgtgaaggtctgtgtgccgacgtgattctcaagctcattcgcagaacacttctgaacccgaacctcctgctgcctttgcttctgcttgcccgctacaccaagaagggccgggacctctcgatcctgcatcccaaggcagcacggaggcttaggctgctcttctacgttgccgtggctcgtggcttcagcggttggctctcagacaaagtccgcaacaactgggtcagcgacaggtatgagtggtccaaggagattgtgctcatcacgggcggcgcgtcagggatcggcgcctcgatagtgaagctgctggacgagctcaaggtcagggtggtggtgctggatgtccagcgaatgacatatacggcctcctccagagtccaccacttctactgcgacattaggtcgccagcaaacgtggccgccgtcgccgaaaaggtaatcggccaaatcgggcatcccacggttgtaatcaacaacgccggcgtcgtccgcggaaagaccattctagatgccacgcccgaggatgtgaggttcacgtttgacgtcaacgccttggcccctttctgggtgaccaaggccttcctgccgcacatggtagctcagaaccacggcatggttgtgacggtgacatcctttgcctcatgggtcacggtccccaacttggtagactacgccgcgtccaaggctgcagccatgtcgttccatgaagggctttcagctgagctcaagacgcgatacaacgcccccaaagtccgcaccgtggtggtccatcctggagcttccaagacggcgctgttcaccggtttcaaccagggtgcgcccttcctgctgccgtcacaggagcccgactccattgccgaggcagtcgtgaagcaaatcctcagcgggcggagcggtcaggtcatcatgccagaagctggagggatgctccccgccttacgagtgtacccggattggcattcgttccgggttcgaagcagaggccagagatccatgctgaactataacggacgacaggtcattgaggatccagccgcaccctttgaggccaacgacagcacagtgctcgtccccacggcatgaatgaggaagccggctgatgcaaatatggccgaaacacggtgttgttgatggcctaggagggcgattcaaacccctttcggccaggtcttacttgagaatgccggaaagctaggtttatagcacctgaaactcgtcccacaatggccagaggtgaacgactagcggcccagcagtgttactctgtaatatgcaaaggatttattatccattattattctggggatttgccagctagcactccaagttggttatcttgcatcctagtgactggatgttcaagtatatgcagctatcgttacttttttcttaatatgttaccctgctgcgtttttcttagtacatactactattgctactttctcctatttctattatatgccatctgcaaaaaaaaaa

SEQ ID NO: 7434 - DNA, 1322 bp, Trichoderma harzianum
cccacgcgtccgggccaacattgcgacgcaaccacaaaggggaggctttgacactcaactttctttgagctccacccggcactaggcggaagaggcgcgtctaactgaaaaaagaaaaaagctttttttctccgagcaggttccctctcgctttctctctctcgcgcggacaacggaacgaatcgaaacagcctcgtctttgtccaagctccaagctccaagctccaaagctcagcctcgcatccgcccgccatggacgccgtccggtctctcgtccagcccatcacacacaacctgccggcccccatccgggacctaggcgtgtcgatcgtgggcgaaacctgctacaaggcgctgctactcgacgtcgacgtcgaaaacacggaatgcatcaagctggccatcagcaagggcctgggcatcggcatcgtcggcgcatcggccgtcgtcaaggtgccccagatcctcaagctgctgcggtccaagtccgccgagggcgtgtcctttttgtcgtacctgctggagacgagcgcgtacctcatctcgctggcctacaacgtgcgcaacggcttcccctttagcacctttggcgagaccgcctttatcatgggccagaacgtcgtcatcgccatgctcgtcctcaactacagcggccggcccgccacggctgcgctgtttgtcgccgcgctggctgtcagtgcggcggcgctgtttgcggacaacattgtggatatgcaggctttgagttacctgcaggctggtgctggtgtcctcggcgttgccagcaaggttcctcagatcctggccatctggcaagagggaggcactggccagctcagcgcctttgcggtcttcaactacttggccggctcgctgactcgcatctttaccacgctccaggaggtcgacgacaagcttatactgtacggcttcatctctggctttgccctcaacgccatcctcgctctgcagatggtgtactactggaacgctccgtcggccaaggccaggggcaagcagaaggaggtgatttctatcggagctctgtccgagggaagttcatcagccgttccaaagaagggtcccactacccgccgccgtggctagacgggtctctctggaggttcttttttcttcttggtctttatctggatgctggtgtacaggtcggaatcagggaatatgctaatgggaatgaagtggaagtgcccaacttgcccgtggcgtgttcgtcatttggtatacttgggcttactatgtatttaataagggatatagccattcatcagcattactattctacttacaaaaaaaaaaaaaaa

SEQ ID NO: 7435 - DNA, 1057 bp, Trichoderma harzianum
cccagcagggtggtggcttcagcaactacagcggagggtctcagggaggctctggctatggcggcggcggcggctacggaggcggttacggcaacggtggcagctacggcaaccccggcggtgctggagcccagtcctcgtggtggtaaatactcacgctctctcgtgatgggcatatcactgtgtctatcattgtggctcaagtttcagccactactctttttttttttctcgtcttcacttttcccttatcgtcatttattctatttgcgcatcaattttgctttgataaaatcggttatttcacatttacgcatcatgtcatttgttttcgacgacacggcggcatcatgacctgcgaaggcggaagagtgccttttttttatttgctgcaaagggcagtaacggtcaggggcatttcacgacgcatgtgatagattgcatttcttttgatttcagcatcctccctcgcttgatacccttagaccgagaatagaggaacttaacgacgctggcagaacgtgtggtgttgagagatctacggttgttagatctggactaggacatcacggtttttttcatgtttctgctgtctacgagggtttcctccccccgcagggcattttctcgcttttcatgatagagggtcatgctatcgccgtggcatacatagaccaaagtggatttactcggttctctggtcggaattactcgacggtctcccacggattgggacggaagagagagctatatgagcatagactgggaatacagatggcctatgggtcggtttctctatttcattcgagagcaagaactgggcctctcgacactagttatggattttggttgggagggcatggatcaaaggctctcggctctttgaccgtcattagcacaatggaacgcttcgactcggccgataggggtgccgagtacgcagccttgaaggaacagggtctttggggagtttttggttcccgtgatagacagacaccagagtggactgaggagtcccaagtaaaaaaataaaaggttttgcgatataaaaaaaaaa

SEQ ID NO: 7436 - DNA, 941 bp, Trichoderma harzianum
ggcatgatgattgttgaacaggtacggaggttgggagacaggagactaacacaccttattgtgcaaactgtacagcacagcagaaagtggttacatcgccagaataagcttgtgattatggcctcaccttttccacagcccgcaggtgacaggccacatgcaatcttggcatactgttcctctctctctacaacagctgaactcagcccagtcgccaaggtttccttcacgctggctttcactcttatcatggagcattgacgagagccggcaccaacgagcataccaaggtgaaaaaaagttctccacaacactccgtccaatgtccaccttacatcctacagtacgcaagggccccgtaaggctattcagcttcaagcacaatcaagccatccaggcaagccgacaaaagccgtcggccgaatctctcctcgtatcgtcctaaaaagggcgcgcgtgagccgctttgaccacaagccttcacgtatcaaacttgcgcatggtgtacgagggagaagaaaaaaaaacggtcctcagccactgagatcccgtttgccaccatcatggtccacttgggtttgttctttagttggggaaagattccagaagctggcactagcctgtggttcgaccgcctccaaagcccctcattcccccaggtttccccaagtccatcatctccaaacatatctgggccagaagacgggggaagcgagagctggggtatgttgaaatcagcccatgagagattgagctgaaagcatgtggtcatatggttccctttacgcgaggaactagaagatcacaaatgcctcacgtctcgagtgcgggcctttacgatctaacagtgtctagatgttcatagtgttcatagtccagcttatgctctcggccagtaccttagcgagtcacgcaatccggacggcgaaaaaaaaaaaaaa

SEQ ID NO: 7437 - DNA, 1319 bp, Trichoderma harzianum
gcactcacccctccaacccctccaaagatctcaccaccggccgaaccctcctcgatctctgcgccgagaatcagctcctcctctccgaatccgtcgcttccaaatatggctccaagctgcccttcctcttcaaggtcctgtccatcaacaaggccctctccatccaggcccatcccaacaagaagctcgccgagcagctccacgcgcgggactccaaaaactaccccgatgacaaccacaagcccgagatggccattgcaatcaccccctttgagggactctgcggattcaggcctctgggagagattgcccacttcctggagacggtaaagccattgagaactctggtcggagagagcgaggcgtcgcagtttgtgcaggctgccaagcaagagggcggtgacgaggcggcaaagaagaaggccctgcagacggcattcggaggattgatgtcgtcctctgccgaagacgttgacagagaaactgctagcctcgttgcactcgccgagtctgagggcgccgacttcgctgccggtggtgtgtcatccaccaagggcgctgtcctcgccgagcttgtcactcgactcaacggccagtttggctccgacattggcattttcgtcctcttcttcctcaactttgtcacactacagcccggagaggcgctgttcctcgtcgccgatgacatccacgcctatgtctccggtgacattgtcgaatgcatggcagcgtccgacaatgtcgtccgtgctggtcttacacccaagttcaaggacgtatccaccctggttgacatgctcacctacaactatgcgcccatcgacgagcaaaagatgactcctaccgaatatccctatgcgactctgaaccgaaatgcctacagctccggatcttctgtcatgctgtacgatcctccgattgaggagtttagcgttgtgcgcactctgcttcgcggagagggggccaaggccactttcgaccccttggagggacccagcatcgtcatctgcaccggtggcaagggtacaatcgccgtgggaccgacaaaacaggagattcaggagggttacgtgtttttcgtcggatctaccgcggaattggtcctggaatccgccgtcggaaaggacgaggagtttaccacgttcaaggcattctgtgagattgatacatctggaaaatagaggctgcaatcatcttcttcaaatccttttccacattatcgaaagatgaacgaattcatgagcaattggaaattttggtagggcatataatacaaaacaagctagaactgaaaaaaaaaaaaaaaaaaaaaaaaaaaa

SEQ ID NO: 7438 - DNA, 850 bp, Nicotiana benthamiana
ggaattctcaagattacaatataacaaatattctccaaaaagaatctctatttctgcagaaaggggaaaaataaaaaataaaaaaccttttaagcttttgttctatcattttttcttcttcttatataaattggcccctaataatctttgctaaaatgtaaatactaaaagggggcatatggaattttttttttccacctaaaaattccaaatggaatcatgattctgttgcatttcatcccactccccaacctcagcaatgtcttcacacaataccataggatcggtaaaagaatacgagggacaagtgtattctctaactggatctcgtaataacaatgccccagctagctccatccacattttaggtgagtccaatggcgactcattaatcgcctgaatttgactcgacgatagacctaccctcaccggaaccaccgtgccaccaccgccacagccacccccctcgggtggctctggagtttgtcttttgaacctcattgctgcttcatgagctgacatttgcacatcttcaggcttagaacttgagggttttggaaaactatggattaattcggggaaattgagtcttgctctctcgccttttagatgaaatgcagcaacatcataggctgcagcagccatctccggtgtctcataactccctagccatattcgtgttttcttccccggttcgcgtatctccgacacccatttcccccattttctcttccttactcctctatacatatgaatattgcttttttcttgaggatcttccattagcaagtttttttctttcttggttgtgttagtttttttaagatgtccggacgcgtgggtcgagggg

SEQ ID NO: 7439 - DNA, 2139 bp, Nicotiana benthamiana
ttttttttttttttttgaagaatagtgcaaatattcattaacaagtgaagttaacagtcgtacatcttttggaaatctgtcaaaacttagtagcgtaagattttgtttttcctcatcatgcaacaaactatcttatcttcttgcttcaaccacgtcattgcccaaattttcctccaagctttacacatgaaaatcatcagctattcaagtctttacagtatttctaccctagacaagtgccttctcaatattcacgcgcactcctaaatagaggtacctaccatatcatctcaatgtggaaatatgtccacagtatggttaatgaacaatatggttagaagatgaaatccacaccaccgcttctaggttagattaaatagtctactatctccgtagggatgacatccctttagattgatgatgtggtcgctttccattcatcccactgtcgctcatactcccttcaacgagatcatcatgtacttcagagaactcatttgtccatgagttaagtggaacaagataactgtcatccttcgagttcctcctcctctcttcataccgttttacattttctgatatctgatggaaagtcctatttagttttgcaattccctttcaactggttccgcaacatgagatactgtgaacctcatatcatcaattattatttcaccacttccaacaactacatcacgaacactctggtggaattttaaacgcttctctctctcttcaggccgagaaatgcgtatacgggtagacctttcacaatcctgaacttcctctgggtctggtggggtgttcagagctgcataatctgacagcacagcaacattcctgacacatctttctccgcgcttgtaaggcactgctgggaaaacataaagatgcaccacagcagcaatacccatctcaagacagatgatatagtcctggattcgtgtcttcaatagttgtgccaaagaacctttgaatgctccaaatgacaaaagaaaggcaacagctataccttgccaccacgtcaagaatacaatcgacttgaatacaagaaacttcgccaatggcttaatcggtgctaatttattcttggtgactgaataaaactgcacaaggcaatatagagcccaggtctggctaaaattaagaacaactgccaaataaggataggcatatctccactcaaatttgccttcaccatagatgccaaaaatttgaaaaaccatagccagtaaagcacatatcatcttaagtatcatatattgcactatcccaatttttactgcttgataaaagtcagggccaagatgccactccctgatcatgcaattcaatggaaaaaggatgttcaacaactccatatgcataggcatcatccaatagaggcaagctggaacttacaacactttgactttccataaattcgattgtgtttttctctccacctaagcaggctatcagatacctctcgaagcaatataatgcaaaagcctcgtaacaatcacgtatgatctcacagttgaatgcggcatttgagtccagtaaggataagaacgattccagtgcataaacaggaaccatcaagattagtccaatcaaaaacttctgctcctcaggctgatggtatgcagctagatgctcgacgattagatacatagacaggactacagccaccagtacagaaaaaccagcactgtacaaagcccagctataaagtggagatgatcctgagactacgtttagcgaccacattttttcagcatttcttgatgattcgaccaaagtgatggagaatagtaacggaaccaaaattcccccccatcccattccactttttaaaacactgcttctcaggatctccaggaaatatggcctacaatcaggatgattcaaaactcaacaagaagcttccatgtcacctcagatagaattaatcactttagcttcttttctggaagaactttccaatactttaataaagcaggttgcctgagtctcttgacaagttatctccaccagaaccatgaattagaagcctggcatcagaaggatcctgcataatacttcatacccataaaaacactgatgctgaatggggacgatcaaattctcaatgttccggacgcgtgggtcgagggg

SEQ ID NO: 7440 - DNA, 1802 bp, Nicotiana benthamiana
tttttttttttttctttttagaagatctaattgctcacaccaactgatcatacacagaatgatatctcaccttttgacataaacttttcctcttttttcttcccaagcaactaaattttagtattaataatagaacaaagttgcatgcttcaacagtacatcccctaaactaaaccattgtttcttgaagtttagccaagtgcttccttcctttaagatgcgcagccatatcaatctcgctaaggcacttaacgttacaaaagcgacaccacagcttagaactatgagtaacaccaacagcattcttcacttcatgttgtcgagtagctcctagtttgaccttttcgtttggcttttcattagtactgcgcattgtttgtgctgagcgtgcatgttttacttgctcctgcttgtctggcttacttgaaataaaaggtgtatttctttcagttttcgcctttttcttgcaagttttcagctcttcacacttttccctatgtttccttcctagaagatggcacttcaagtcatgctctgaggtggttgtcacttgacatactgcacaagtccactctttctgaacgctctttaaagaattagtctcccggtgtttaatctctttgggattatctgttggaagcgttgtttccttgatcggcacacttgttgttttcttcccagcctgaactagattttccttctcacttttaacctgtttgggctcagctaattcattagtactgtgctctgattgtgctgcagcaggatgttttacttgcgcctgtttaagctgatttgactttgttgtaacagatgagattccttcacttttggccacttgcttgcaagttttcagctcttcacactttgccgtatgtttacggccgttaagatgggatttcaagttttgctctgatgtagttgtcacttggcatactgcacaagtccactctgtctgaacttgctttacagaagtaatctctggaagtttaatctcctcagcatatgctggaactaccatttcctcgacctgcattcctatcgttttcttctcaatctgaatttgattttccttcacactttcgacctgtttgggctcagctacttcatgttttgccatgagctccatcactttgatatcttcccaaacaggaccactcccttcacatgctgtctgattagtgcgccacttgtttgaaataagtttcaccagagcatcagatccatttcttcaagataccttttcccccacagacagaaatgtttcattcttgagagatggatcctccattggcttgttaaaccagtcaataaaagtttgaagattgacaaacgagcacaaatatgcaaagtattggtaaacataacaagaaccataaaactgagcaataacattgtgcagtttcaaaggcaaacatggatgaacaagatgttgatatgaataacatgcgccgttaaactcaggtattaccaaccaacatatagtaattaattttatataaggccacagaggaacccattcaataaggttctcaaatacgtgctcgaacagagaaataaaggaaaagatggtccaatatgttactagcttcctcatgtgatacttggagccagtctcaatcgctcggattgaagcacatataggatagcccagagcaagtaccggccaagcgaggaaatcgatcaactgaagcgtaaaactgagaaaacccatttgagaaaatcttttttttttctttccttttgtagcaatttcctcagcttgaattcagtcaagttcttcggacgcgtgggtcgagggg

SEQ ID NO: 7441 - DNA, 891 bp, Poppy
gttcttgtcattaattaagtcgacgaattcaggagaaaaaccagaaactggtttcatcatagtgatggcaaacatgatcatggcttcctcatctaaaaccctaatcacatctccttcaatccaatcaacaccaaaattccaacttccccaattcacaaccctaagaatcagaagccaagccaatcaaaccagcaccagcagcaacaaaatcaaactcccaactctaaacctaaactcactcaaatcaacagcagcaattgcagcagcagttctaacaatggctccaccatcactagcagcagaaattgagaaagcagcattgtttgatttcaatcttactctaccactaatcatggcagaatttctcatacttatgtttgccttagacaagatttactacactccattgggtaactttatggatgcaagagatgcagatattagagggaaattgaacagtgttaaagatacgtctagtgaagtcaaggaattggatgaacaagctgctgctatcatgagagcagctagagctgaaattgctgctgctttgaaccagatgaagaaagaaacaactgtggaagttgaagcacagatggctgaaggaaggaagaaattggaagctgaattggctgaagctcttggtaatttggagaaccagaaggaggaaactattaaagctcttgattctcaaattgctgctcttagtgatgaaatcgttaagaaggttcttccagtctaagttctattctatctcttacttttcaattattgattaatgtttgtatgtcataatcaaatacaatttagtctgtgtaataatggattactgcttttgaatttcttgtttatatatcaatataagctttttgcttcttcattttaaaaaaaaaa

SEQ ID NO: 7442 - DNA, 1323 bp, Trichoderma harzianum
aaagcgaccacgagcgcatgcgcagatgactgactaagcggcccgttggcgaacaaatagtgaggagtttcgctgcgtcaccgcctgcgcatccgcatctgcatccgcccgccctggacaagaacaagcgagtgcgacgatacaatggacaaggacaagccgggggacaacaagccggtggacacctcgggcaaacatggtcacgacgaaacatcgcctatcgcaacaccgaccaagaagcctcgcaccgccagtccagctgagccagccgcagcgtcaacgaggcttgagccgctccaggcgccgctcgtcacagacccgacgttggatgcgggcatcgaagcagacgacacggccagcgatggcggctacgagtccgatttggcgtcgcgagcgtctacgtcggtatgcagcgccgtgcgcgactacgaattcgagaacaacaggcgctaccatcgctttcaagagggccggtatcagttccccaacgacgagccggagcaggagagggaggacatgaagcatgccatggtgttgcatctctgtcaaggcaaactccactttgcgccgttggagaacccacagaatgttttggacatagggacggggacaggtatctgggccatcgacatgggagatgaatatccaggagccgagatcacgggcatcgacctgagtcccatccagccgcagtgggtaccgccaaacgtccggttcatagttgacgatgccgaagcagagtgggtaattccggaagcctctctggactacatccatatacggcatatgacttcttcaatacgcgattggcctctattgttatcgcgcgcatacaaagcgttaaaacctggtggatggatcgaactgcaagaacttcaattccaagtcaagtgcgacgatggaacggtgcgcgaaggcaacaaagtccaagacttcttcgagacgatgaagcgcgcacttgggaatttcaacgtcgacttgctagcgatgcgacacaacaaaaagaacgtcaccgacggaggctttgtcgatgtcgacgaaatacccttcaaaatacccattggcacatggcccaaagacatcaatatgaagaaatgcgggctctacaacaggagcatgattcacgatgccctctacggtgttgccgtgaggccttttacgcgtggcctcggatggacaatagaagaactggagctgtattttaatagacgtgcgaagagagctaacagacaacagtcagcacggctatacaccatttaatgtggtgataggccgaaaacctggataaaaatatcaaacatttcgatgataaaaaaaaaaaaa

SEQ ID NO: 7443 - DNA, 1157 bp, Trichoderma harzianum
aagtctgccctccaataaacgcttcttccccctcgagtccagactctctgttctgccactggctctggctctggctctaagcgatctccgccccggtccgtccaagcttgccccccgaagatgacggccgatgccatctccggctccgggcccgcatccggctctccccagcctctccggctgctcatcctcgaggccgatacgccgcagcccatcacaaacgccaaatatggtggttaccgcggagtcttcactgctctgttgacggcggcggcggaaatcatggttccgccacggcagctctccgacgtggccacaatcacggcgcacaacattgtggaagacatgcagtcatacccgccgctggacgacgtcgacgccgttctaattactggctcgcgtcacacggcatatgaggatgacccctggatcctgaagctggtggagtatgcaaggcaggccatcgacaccggtcgcatcaaggtcgtgggcgtgtgctttggccaccaaatcattggcagggccatgggtgcgcggctcggcaggagtgataagggctgggaggtggccgtcaccgaggttgacttgaccgacaagggcaaggccattttccagcttgacaagatgcggattcatcagatgcatcgcgacgttgttctagaatttcccaagggtgccgttcccctcggcggaaacgacatgtgcccagtccaggctatgtacagccctggtcggtacatctccgtccaaggccaccccgagtttacgggcgacatcgtgacggaagtcctcaccaaccgacacaaggctggtatctttagcgacgacatgttcgacgacggcatgaaacgtacgcccatcgagcacgacggtgtcgccatcgcaaaggcgtttctcaacttcatgaggagcggttaatgtacatcgacaagacacgatagctgaggcggaatagaggcacacatatgcaagcgctgattcgactgcctcgtgcccatatcatcagtaggagtcaaggctggcacacttttttttatgtacaaatactcttttatgcattcctacttccgattatagacgaatcacatttgccaaagtgcggtgagctctcacctgcagtgggagttggctaaaatcctattcaaaaaaaaaaaaaa

SEQ ID NO: 7444 - DNA, 1818 bp, Trichoderma harzianum
aatgaacccaaagaccattgaagtggcctcaatattgatctatcaactttcacctactctcgaacgtttattctcgaggtaatagcttttgaagttttcatcatgtccaaaaaggtggtcatagtcggcggtgttggcggaggcatgtccgctgccacccgcttgcgtcgtctggacgaatcagcaacgatcaccgtgtttgagaaaggagcttacgctggctacgcgaattgcggtataccttatgctctgggtaaggtgatcaaagatgacgaagctctgattttacacacaccaaagtatttcaaggaatatttcaacatcgatgtttacctcaacaccgaagttattgagattgaccgcacgaacgagcaagtgtgcacacgaaccgttggagagactgagattcggcgagtcggctatgacaagctcatcctttcccaaggcgcagaagctgtgcagccgcagattgttggagtagatcagagccatgtgatcactctacggaccatctcggatctacaagctattcgatctatcatggtcgaacgatgcgtgagagatgtttgtatcattggaggcggattcattagccttgaagcggccgaaaacttgcgaaagatgaagtttggagtctcaattgtcgagcaatggacccatgtcttgccgtcaatagacgccgatatcgcacagtttcttcacaccgaactgaagcacaacggggtgaagttatacctgaatgatactgcaagaagaatcgaagactctcatgtcgtcttggctagtaatggaagagagatccctgccgaattggtcattctagctgtgggagtaagggcaagaacatcactggcaaagatggcgggcctcgaagtgggaacacagggagtcaaggttgaatcacacatggaaacatccgacgaagacatctacgctgtaggtgatatggttgagacgaagcatgtcattcaacaacagccaagggtagttgctttagggggcccagcaaatcgacagggtcgactcgccgcagatgatatagccggcagaccagtgcactatcgcggcaacatcggcacaatcatctgtcaggtcttcgatttaaccgtcggtttagctggcctgtccgtctcggcgctgcgtgacttgggacaggagccgctctgggttacagtgcatcctccacaccatgcgaggtattatcctaacgctcgtccaatcacgatcaagaccgcgttcgaaaagggcacaggccgtattctgggggtgcaggcagtgggaatggctggcgtggacaaacgcatagacgtcctggcaacagcgatgcaagctaggatgacagtcaatgacctggaacatctcgaactgagctacgcaccaccctatagctcggccaaagatcctgtgaacatggtcggatttgttggctcgaacttgctccgcggggactatcagatcgtacacgccgaagacattaacatcaagaatcttcatgcctggcaagtcgtggatgttcgcacacccgaggagtttgcgactggccacctcccgggggcaatcaacttgccaattgcaacactgcgcaatcagaaattggagcttgaccaatccatgccaattcttgtgtactgttatgtgggctatcggggatacttggcctaccgcatcctcagtcagagaggattcagcgtagtaaaccttgatggcggactgaagacagtagtcgaggggggaaccaggctttggaagaaatttgttcttcagaaaatttgttcttcataacctaacatatttaagtgatatctaagtaatataatc

SEQ ID NO: 7445 - DNA, 1047 bp, Trichoderma harzianum
gcttcaatcacccttgaataatgaacgaggaaaagctcggccacagtaatcatgaggacattgtgcctccagaatcctctactggagatgaattacagacaccatctacggattccaagggcaaacagaaggcaggcctggagttagcagcatctcaacttggggcctctacaaagctggtcgtcaatgccatcacaacgtttcgggaaatgccagctttggcatcagaatcaaagtcctctcatggttcaagtagcatgggctcgttttcatctatcgctggcgagtactcgtcatacaaaccactccagaatccgttgcttgacgagactactcatgagggccaggatgatttgtttgagacgtttatcaagagttcaacggatgcgttggtaaatgatggctatcaagtagacgtttcaggatcctcatttgcagatcaagaagcatcggatggcttggccgtttttgaatttctctcacagccaggaaatgaatcgatcgagacggccatttctagggaaaatgattttcagatctcaggcgaggatgaatcatggagtgaagctgtggctggaacactcatcgatgagaacgaccaacttgattttactcctgattttatcactaatcccgaactgtcttctcaagcagcgccgtaccttggaacaacgaacattgaagaaacaagtagtacttggtttgggtattggggtaatgtgtttacagcgtacaatgcccggatatggggtaattcgcatccaatacccacttcggaaacatcggatcaggaactcgaacaagagcaggatagcagggagtcgacgaccataaatcgggcgctcgatcggttgaaactcatattctatcacttgagaggatgagaatgtagcgccggaacaagaagtcaagtttttaatgttgttgtagcagtatgtcacgatttattacgacagaaccagaaaaaatgtaccatatacgtcaagggttaattataatatatatccatattataatttgttgtcacatcgaataaaaaaaaaaaaa

SEQ ID NO: 7446 - DNA, 1723 bp, Trichoderma harzianum
cagcaatcatgaataatgaccaattccgaaagttgatgctggccaagtcgggcaaagcgtcaaaagatggcgcttcatccaaaggcacgagctccggtgcgaacacgggctccttgggatctcggcagcggagcagcatacctatgactccgcgatctttgggaggtgcccaggccgatttcgcgagacagctggctgagcgcaaccaagctctaaaccctccaaagaagtttaagacatctgtaccaaagggtgtgaaactaggggaaggatacatcgatagatcgcaagttcgagagagcgaagaggacgaccgagaagagagactaaaggcgttggaaaaagctttcaaagacgaagaaattgacgaggcaacatacgaaaagctacggtttcagattgcaggcggagatctggcaagcactcatctagtcaaagggcttgattttaaactcctcgaaaggatacgaaaaggagaggatgtctacggaaataagggagtagaaaaggatagcgccgaagaagcacccatagaggacgacgtggatgacgaattcgatcgactcgaagaacaagacgtacaagccattacgaaagaaaaagcggaaaagaagaagggcactctttcaacagtgtctctggcacctgggaaaaagagaacacgcgatcaaattttagcagagctcaaggcagcccgattagcagcccagcagcagcaagaatcagctctcggagaccgatttaaaaagattggggcaaaacagaaaccaggaacccggattgagagagatagtaagggcagggaagttttaatcattgtggacgaggatgggcatgagaaacggaaagtccgcaaggtacagcctgaagaagaggatgcgcggaacggtcttctcatgccagataagaacgccaagccattagggatggaggttcctgagcaatatcggaagaaagaggagccagaggaagatgacggcgatgtcgatatttttgaggatgctggcgatgattacgatccactagccggaatggggggttcagactctgagtcggacgaagaggagaagggcagcagcagtaaccaggaggcagacaaggaggcagacgccaacaaggcgatgccgcctccaccaaaaccatctgtttcacaaccagaacgacgcaattatttcaaggactcaagaacggcgctcatctccgaggaagcaagcagagggccatccatgtctgatcccgccatattggcagccatcaagaaagcagcatccctcaggcctcttgagcaagatgccgaagacgataaagctaaagaagcagccaaggcactggaagaacggcgaaagaagcttcttcagatgcagagccgggatgatgatgatatcgatatgggcttcggcaccagcaggtttgaagatgaggaggactttgaggataagaaagtgaagctatcgaggtggggcgaagacaccggggaggaagggtccagtaggggcgacaagtcaaagcggaagagagggccaaagaagcgaaagggtgatgtcaacagcgcagctgatgtgatgcgggtcgtcgagcagcgcaagaagtcagagtaaggtccgccttgggaggccgacaagcccaactttgttggcgcaatcggcgggcacaatatgcatttcgattcccccagagtatccatataccgctggataaacaagcaatatacgtactagatacc

SEQ ID NO: 7447 - DNA, 1858 bp, Trichoderma harzianum
cgcaagcaaaagatgcgaggcagtgtcgtggctagcaggcccttgagccggataagctgctcggcgtgttgcgcgcggagccggcagtttagcaggtcgtttcgggtgcagtcggcacaaccagtggtcgtgcgagcgggattgagtggcggcgttggaagatatctcgatgctcgagccaagcgtggtacatatcaggtttcattggcgacgacgagatctttggcgacagtttcagatcgtccggtggttggactgggtccgttggaggagtatgaccggcgggtggacgctgggattctgcggaacgacgagcatcaacgaggcatcatcgagaacctgcaacatcttcacaatgagcttcgcaactaccatgcaccgcccgttgtccatcccagcttcgatctcctcaagcccgccaagaaatccgtcttctcatcgttattcggcaatggaggcgccgcaaaggctacaattaaggatatccccgagaacttacctcggggattgtatctatttggtgatgtgggcagtggcaagacgatgctcatggacctattctacgatacactacccagcacggtcaagacaaagacgagaatacatttccacaactttatgcaggatgtccacaagaggctgcacaagctgaagatacagcatggtagtgatgttgatgccgtgccgtttgttgcggcggacattgcggagcagggcaatgtcctttgctttgatgagtttcagtgcaccgatgtggcggacgccatgattctgcggagaaagcctcatgtctcacggcgtggttctggtaacgacgtcgaaccgacatcctgatgacctctacaagaatggcatccagcgagagtcatttatcccggcaattaagctgctcaagaaccgactacacgtcatcaatctcgattcgccaaccgactaccgcaagatccctcggccaccctcgggggtataccacaccgccctggaccagcacgccgagtcgcacgcagagaaatggttccggttcctcggcgactcggagaactttgcgccacgctccgagacgcagagggtctgggggcgcgacattttcgtcccgcgcgtcagcgggcggtgcgcctggttcacatttgacgagcttatcaagaagcccaagtcggcggcggactatctcgagctggtgcgcaagtacgatgcctttattgtcaccgaggtgcccggcatgacgatccgcgagcgggaccttgcgcggcgcttcatcacctttatcgacgctgtttatgaggggaatgctaagcttgtgcttactactgagaagcccctggccgaattgtttgtctcgcgcgatgaaattgctgagacactactgcaaagtaacccgacagccgagactacaaaggccgctacggaaaacgtgatggagaacctcgaatctagcgtcgtcgataagctcaagaactcgaacctattcgccggtgaggaagaggcctttgcgtttgccagagccctgagtcggttgagccacatggagagcaaagagtgggtagaaagaggacttgggctggaaagccagggaggcaaagaggacaaggacagctggacgaagacgcgaagtcgacagatggaggattcgatgtgatttcatattgtttttggtacgtcattttgttaacggggatttgggtcccccagggcggttcattgtttgctgctttacaataccctgagcggatttacactagagatactatttgcctagacggacggatggacagggcagcatcttgggatggatacagatacgtccatgcatgttttccttatgtgtaccatatgtttactatttaaaaaaaaaaaaaaa

SEQ ID NO: 7448 - DNA, 1844 bp, Trichoderma harzianum
actctacactattgattgggataacatgcctctgccccaagccttggtgagagctgaccgtgaggcactgcttaagcttcgccatacctcgttgaccacgccgatatatgccgacgactctttcaatcccagaaagcgcaagtcgaatgattttccaaacaatgatgcatccgtgccgccttggcactctactaactcaggccgatccctcgaggatcgcatttcgtattcccccgataagcgggtagccctcgatgacagtaagttccagaaagaagccaacaagcgaaagcgccgtttcgaaaacgaatacaaggcggccaacgtagcgtcgctcagcccaactccgccatcatccggccccatcgtcggcacctctgaaacccttgaaaagaagtatctccgcctcactgccccccctattccgtccaatgtgcgacccgagagagttctccgtcaaacgttagatttgttgaagaagaagtggcgaaaggagagcaactattcgtacatctgcgaccaatttaaatctatgcgtcaagatcttacggtgcagcgcatcaagaacgagtttactgtttccgtctatgaaattcatgcccggattgccttggagaagggggacatcggtgagtataatcagtgccagacccagttgcgatcgttgtatgcaatgggcctgaagggaaaccccattgagttcaaggcatatcgtattctctatttcattcacacggccaatcgcaccggcctgaacgacaccctggcagatctaacagcagcggagaaggaagagaagcccatcaagcacgcgctcgacgtgcggtcggcgctggcactgggcaactaccacaagtttttccagctatatcttgacacacccaacatgggtgcatatctcatggatatgtttgtcgccagggagcgccttgcagctctgtgcaatatttgtaaaggatacaaacctgacatcaagctgcgcttcatcactgaggaactcgggttcgaatcagatgctgatgctgctcagttcattattgattaccaggggcaacatcttcttgaagaccgcacagagtacattgcgttcctgaccggtaaagccaataacctctttgagaactctagagcgtcggctttccggaaagtggacatcaaagggcagatttaacttggttgttgctccttgtcacgttgttcctgcgcctcttcctctccgcgcctgttttttcctgcatgtggctcgcattcgccagcgtttttctgttgcatttcctcttctctatctctttaaagattgcaacctacccctgatacctaacgatagcatcttgccgattgcggcgaggattcaaaaagtctttttatttctttggacctgttcctttggacctgtttctttggacctgtttctttggaccgcatctgttgagaacccaatttcgcacgacgagtcgtttcattctcctctgcacggttcagtactgagcaaccaatactctgttcccgctcggggaacggggcaggcttttgccagtcaccttgattacggcgatgccctcttcaaacgattttgtcttctaacttggcgcgccagatctctgcttccgttataagcagaatatcactcgatccatagtagcaactccaaccagttggatgttgaaaggaatttggaggatatgtgacaagatgtttgcgccgaactgctcccttggcgagagcggatatggcgttttggcttcatcatcatcacggtcggactacagcttgggaagtttaagatggtgtttggcgttggtagtagtttttattcttgcagggtgtgttgggctgggacagtc

SEQ ID NO: 7449 - DNA, 1292 bp, Trichoderma harzianum
cgccatgctgtgagttgtctctcctctgtcttgtatccaacgaacctggtcctggaaggctgcagcctcactgcctcacgttctcgtacgccgccagccagtgctagcatccgcatctcccgtggctcgtcgcggtgcagcaagcccccgtcactccttggtcacagagcgccatcatcatgccagcgtcgttgtcaccaagccctcagtcctctcagtcatccctgatggagaccattccagatgacaagggtcctgatttgaccctggataagcctttgccccaacgccccaggacgcccgctaagctcttgcgtcttggggtgcggaatcgccgccacgagtacctggtgaaaactcggtcgtattttgacaatctggaacatgaacttgctggtatgatatcgcatctcatttttttcaatctctctcctgttgtcggctgatgggtcatgtcgacgatcctgtagcctcgagagagacctcatcatccctttccaaacctgacttgacctgaaaaccaaccattgcggtgtcgtgtagatcctgtcttgtatgagcgtcttgtcaagagatttcaaactccagccgaacgagaggcagaaggaaaagccaagggctatagtcgcactctcgaagcagatctcgttagaggcgagacaaatctctcaaatctctatcctgaacgagagcagggtagccgaacaccacaagattcaaaagtgctaggcgacggaggcgcgggcaccaatgcatgggacgccgatgcagaggacaaagagcacggcaaacagctttggcatgcgtacctcgaagtccgcttcgtggagggactggatgaagacttcgactatgaaaaggttgatgacaattataaatacgacaccatggccattcaggacgccgaggatgcttggttcgatgacgaagagcccagctgggtagatgggggaacgcagtttcctgttcggctaggagagacgggcatccaggatttttgagtctcatcgatagacgctctggtggtcttgaactttttcattccatagattgtctcggctgagggctgaaaaagtgaacaaccctctgagttgccgagtatatgacattgctaggcgttgtatcgcagaggacacggcctctgcaaacatctgggtcactattctcttgcgccggcgctagtgaggacctgtgtcatgaagattgcttggtaaactttcgtgtctgtaaactcccgatccatagaatttgtctccgtaaaagtctgtcttcgtacccacgaaaaaaaaaaa

SEQ ID NO: 7450 - DNA, 1406 bp, Trichoderma harzianum
ctttcctccaaatcaagtcatccgattcatccacagcatgacacttccccaaacgagattatttccccctcaagcactactccggaatacccaaagccagaagtttatccgaacgattgcttcaatggctactgatgcacctaatttcccatttcggcgagcttctggcatggagccaccagccgagttcgcacggttaagggctgttgatccagtatccagagttaagctttttgatggaagcttggcttggctggtgactaaatacaaggacgtaattactgttgcaaccgatgaaaggctctccaaggtccggacacgccctggcttccccgagttgggtgctggtggcaaagaggccgccaaagcgaagccaacattcgttgacatggaccctccagaccatatgcatcaaaggagcatggttgagtcgatattctctgctgaccatatcaaggagctgcagccatatattcagaagacggtggatgatctccttggttctctgaaagctaagggttgcgctgatggccctgttgatttgattaaagagtttgcattgccagttccatcatacattatctataccatccttggcgtgccgttccacgatctcgaatatcttacccagcagaatgccatacgaaccaacggaagctctacggcgcgcgaggcatctgccgcaaaccaggggttactcgattatcttgccaaattagtggatcagaggatccaagagcctaaggatgacctcattagtaaactcgttgtggaacaagtaaaacctgggaacattgaaagggcagatgccgtgcaaatagcttttttgctgctcgtggcaggaaatgctactatggtcaacatgattgcattgggagttgtgactttgttccagcatcctgaccagcttgcgcaattgaaagctgatccttcactcgcccctgcatttgtggaagagctatgccgatatcacacagcttcagcactggcgattaaacgaacagcaaaagttgatatcgagattggcggcaagcttattaaagccaatgagggcatcattgcttccaatcaatccgcgaaccgtgacgccgacatcttcgcaaatccagacgaatttaatatgaaccgcaaatggcctaatgaagatgctcttggatttggatacggcgaccatcgatgcatcgctgagactcttgcaaaaaccgaattggcaaccgtcttctctacactttttaaagaactgcccaatcttgagctttcagtgccaatcagcaaaatcgactttacgccattgcataaagacgttggaatcgagaatttgccggtagttttctaaggtggaagtcgttagagctcagcatcgaagcaacaattcagaccagcaacatactccaaaaaaaaaaaaa

SEQ ID NO: 7451 - DNA, 1134 bp, Trichoderma harzianum
aagttaaataagggccaatggacggcgatcatgggagcccgtcttcaactcacttttgccaatctgcaggctctcaaccgacagttcaatcaccgcggcgcaatggctgaaaacatcctcgttctgggtgctggcgagcttggcctcgccgttctggaggcgctctccagacaccccaagcgcaaccacagcaagattaccgtcatgatgcggcaggccacgctggactctgccgcacccgataagaagaagctgattcagcaaatcagggcgctgggcgtcgactttgaggcggctgatgtggtgcaggcttcggtgtcggagctcgccgccatcttcaccagatacgacactgtggtgtcctgcaacggcatgggcctgccgtcaggaacgcagaccaagctctcccaggcggcgctcgaggcaaaggtgcggtggtttccctggcagtttggcatggactacgatgccatcggcctgggcagctcgcaggacctatttgacgagcagctgggcgtgcgagcgatgcttcgcgcccaagacactacggaatggatcatcgtgtcaaccggcctcttcatgagcttcctcttcgttgccgagtttggcatcgtcgacttcagcacccggacggtgcgcgggctcggctcgtgggacaacagcatcacgctcacaacgcccgtggacattggccgggccaccgcggagctggttctggatccgcagggcctcaagaaccagtgcgtctacgtggcgggcgacactctcacgtacgcgcaggtgggcgatctattggacgagcgctttggcactcgcttccggcgcgagctctgggacttggacgagctggccaagcagatgcgcgaggatccggacaacacaatggtcaagtacagggatacgtttgctcaggccaggggggtggcttggggccaggacaagacggtgaattcggcgcgggggatgaagatgacggatgtgaaggcgtatctggcggcgatggacgtccaactggacgaggcactgtgattgattgattgcgctgtaatgggtcgatgtcatgtattatcatcatcttttatcttacttgtctgttaataatagaatagaattgaatgaaacgaaaaaaaaaaa

SEQ ID NO: 7452 - DNA, 1282 bp, Trichoderma harzianum
ctctcatcttctctccaatccccaatcctcaataacctacgccgtgtcagtcaagcagctgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagcaggagggcgtcgtggcccagggcaaggctgccgtttccaccgccttcgtcattagcaacgaaacgctggcctggctgagcagctgggtcgctgtcaagaaggccgacgcctctgaggctaccaaggagaagatcaaccagtagacgatttccggagtggattacaagcgaaacagcgcatcatttcctttcttgaccggccctctctctcttctttgtctttctcttcttacccttttgttggcattgagtcgactttctctgtcactggatctcatttgctttgttgatgccagttcgcttttgtgatgaacagcacctagagaaaagggggaagaagggcaggctgcttcgtccgctgcgactaggcgtctacgtctggcatcatgatcgccactactagctagtggccaagctctgacgcatctcgtttcgatttcatctctctttgattccttgtttcggcggactatggctccaccacccgcagtttcaacgctcgtcacgttgctcgagaagtgcgaatcatgagtattgatggggatgtgggcaaatctgtatcggcagcaacctttgacgacgagagggctttcaacacgggacacttaacttttctttgttttgatgtatgggcaattatatggaaggacgtaaaaagggtagaataccaatgggagtttgctttcaatgctaataaagacctcgacactatccaaaaaaaaaaa

SEQ ID NO: 7453 - DNA, 1208 bp, Trichoderma harzianum
cccacgcgtccgcccgcctcagcatggaggatatggaccacctcagcctcaatacggcggccaccagaaccaatatcctcctcccggcggccctcccccgagccactacgcacctcctgcgcaccatcctcctccgggtctagatgcttacggctatcctctcaaccctccgactgccatgcacgcaaaggccggccccccgcctccctcggcccctcagcagtttggccacggtgctccgggcggctacaccttccagtactccaactgcacaggaaagcgaaaggcgctgttgattggaatcaactattttggcacaaaggccgagctcaagggatgcatcaacgatgtccacaacgtgtcggcattcttggttgagcgatatggctataagcgcgaggacatggtcatcctgacagatgaccaaagcaaccctgtcatgcgcccaaccaaggccaacatcgtccgtgccatgggatggcttgttaatggcgcccagcccaacgatgccttgttccttcactattctggccacggcggccagaccgaggacaaggacggcgacgaagacgacggctacgatgaagttatataccccgttgactttgaacaagctggacatcttgtagatgatgagatccacttccatgttgtcaagcctctgcagcagggagtgcgcctcacagccattttcgattcatgtcactcggcaaccgtcatggacttgccctatgtctactccaccaagggtgtcctcaaggagcccaatttggccaaggaagctggtcagggtctcttgggcgccatctcctcctatgcttcgggcgatatggccggcgttacgagtagcatcatgggcttcgctaagcaggcattcggcggtgacggggcttacaagaagactgtggctacacgcacatcggcagcagatgtcatcatgtggtctggcagcaaagatgaccaaacttctgccgacgccacgattggagcgcaagctactggtgccatgtcgtgggccttcatctccgctctgaagaagaatcccaagcagagctacgtcgagcttctcaacagtatccgagaagtcctcgagaccaagtatactcagaagccacagctttcttgcagtcaccccctagataccaatcttctatttgtcatgtaaacttaacaaaaagaatgatatccattgaatacaaaaaaaaaaa

SEQ ID NO: 7454 - DNA, 698 bp, Trichoderma harzianum
gccggacttgggtgaaaagacttcggtgccttcgacttccatccgctggtccgtcgcaagctcgacgggatccggggcggatgacggggacctgactgtgcctgcatcggtcacggcgccggagggcgtgacggaagagaccattgtccagcgattcgcctgggcttgctgcggtgacaactgcgtattggccatggggatgtcgcccggggcggcaccgcttgcgcctccggattgtagggaggcgtcgttgtatacgcggcgctctgcagcatttctccgctttgtgagatagaaccacacggctgccgcgacgaggaggccgccgcccaccactgcaccgacggcgatacccgcttccgccccgggagagagacccccggacgacgaggacccggagttgttggagtcgccgcccgcctcgagggtgctggtcgggcccccggttgcggtggagcagtaagccgatccggcgaacgaagtacatgcctggccgttgttgcagcagccgttaccgtcagagcaccggaactgaccggtagtacatccgtcagcaacgggagtgagaccgggaggcgggctcgtcttcgtcgagacgcagtgcccgccggcctggcagttggagtcaaaggggcagcagttgccgccgaggtcgggggcgcagaggtagaagctcgtctggggacaggcgcggccgc

SEQ ID NO: 7455 - DNA, 876 bp, Trichoderma harzianum
gtttcgattagcattacaccagtaaccctccaggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcactgccgtgggtatcagcaaggcgcaatggcgaattgcaggtgggcagcgagaaaaattcgaagggatagccttttaccagcgctgcgtcgatgatgaaaatggcctgatttcttgctcgcggagctatgccgggaccctgcaaccgcgaaatgggctgccaccggccacagagaaaacagaggccacagaggcgccgggcggtctcgaagggcttttggggaccctctgaggcgctggaggggtccctgcgccatggatgccatgcatgtgggaagaagagaaaaattgctgctcgaatatcgtatgattcgcaaggttgctgaagggcccaaaggagccacgtcggcgctgattggccaggccgcttcctgctgtcggcgcctcggtatcgagcttattgctaccccgttaggcaaggggcggccgc

SEQ ID NO: 7456 - DNA, 980 bp, Trichoderma harzianum
attctccgtgacatttgcgacgacgcacagcccagcgagccgcgtcaccgcctgaaacgctttgcctaagctattgtcttcatttcccacatagtggcgggaatcctgtggaaaggcgccactccaacagcggaagctgtgggtggctccagtaaaccggactccatcatgtcgcagcctcccggacagcctcgcctttcaccccagttctgcttctcctttggcacgcttcgtgatttcctgcggctgtctcgatcatcaatagacgactccatcactcagaatctcaatgctctggtaacaccggctcggacgggcttcgacccgaactcaacttcaaaacgtgccccgcgatcctttgccgagccgatcggccctgaagcatgtcagtctttcaaagagaaagtcttgtttccgtcgtggaaggctagagccgaagtgctcagctattgcggcatcgttgccaccagcccggaccccgatgaccccgaggctaccgttttagaactggaaaagcagagagaccgcgagcggattgttgatgaaaggctggatccgtattcaggacgcttcttcccccgagaagctcgtacgcagtcccttgccctcctgatgcgacaggaacgagccgtagagaacattgtccgcagcaggacttgggacgtcatccagggaagatgcggtacatctagtcagagttggcaagatgctatgagcaattgggaggctgcacagaatctcagcaaaggtgatggcaacccgacttcatcatgacacaggatgggacaggaaccaacaccacctcggtagtatggactaatgatgcagcatgtgcttgtacgattttgaatgtgaaaacgaatatagggattggaatatagacgccaagcttgtatataaaacaacagtgtactcagactacttacaatgtgcactctgtacaatatgaaccccccttacctttttaaaaaaaaaaaaaa

SEQ ID NO: 7457 - DNA, 976 bp, Trichoderma harzianum
cgcaaacgcacgcactcgcgcacaaggcagctgataatccaaatctacctacgcataataatcttcaacaacctgcatccaacgaagcgaaacccaaaaacaacatacatgagtgtaacaccaccaaacgtccctcgcatcgaagacaagcaaagcaatacgatgccctcacaacgtcccttcttcctctcctccttcttcaactctttccgccagcaagcgccctccctcacccagcaggcggccagcaaacacacctcgcaagctgctgcatctgcatctgccgtcgcctccacaacagccgcagcagcagcagcagcttcttcaaccgcctccaccgcccgcgcaatctccacaaacgctgctaccacatcatccaccaacgtcgccatccacacgcctcgcggatctcccggcggcgccatccccattcctggcgggcgcagaagaggcagcgatagcagtagtgaaggctttcgcgatgccctcggcgccgacaagtggtatatcggcggcaggacggcgactggagaggagaagttctttaagcttggcgtgatacgccgagtaaggagtaatgatggcctgagtctcgatcgcctaagcttataggtgatgaccacatcactgaacgactcgagaatgactggttttgattttttttccccctctctccttctcacctcttcctgcttggccaccagcaacgagaaaaaacgtatatacatgattagagcgactttggaatttgggcaacaaggctgcaaaacatcaaaacaacgccgacgggaaggcattcatttgggacttttgggtttgggatttcgagacatgggcgcggcgttttggcaaccggttgggaattttttgacgaacgaaactttgcattcgtattctattctatctagcataagaagaatgaggctgctcaaggacctcttaacaatacaatattctatcttaaaaaaaaaaaaaa

SEQ ID NO: 7458 - DNA, 1309 bp, Trichoderma harzianum
gcgttttgcattggccaatatagcctggaactttattttggggcaaaagcaagaagcctggaacaagcttgttgtgtttgttagcgaccaaaaaaaaggtacctgcgactacaactgagggtcccccagtggctgaacgacgacttacacccgttggcagcagagcttttgtcttttcaccacaacaattttgacattcgtctatacaaaacttgcacggtttctttcacctggcaggtagcatctcgacattcaccatgtccaaactccagatttgggcctcgtggcccgaagcccacctcttcaacttccctcctgccaaccctccggccccaatcccaccggcacatgtccctgccactattctgaggcccttcaacatcccagatgatctctatgtgtctgctctggatgctcgagttccgttgacgattgctgctctttatgccatctcggccaagctgctcaacaagtacaacaaggcgcgcaacaagaagccctggggcatcagcaaaacacgccccttcttcgtctttgtcgtcctgcacaacatcttcctcgccgtctactctgcctggaccttctggggcatggtcggcgtcatgcagaggagtttcgtcagcccctttggccctggcggcgtcgcagctactgcggatggcttctgccgcccccacggacctcgtggcctgggcaactccatctacttcaacgagaccactttgagctgggacagtgcttcaccgagctccgttgcgcatctgcttgcttccaatggcatgcctagcaccaccgagcccggccggatgtggaacgagggtctcaacttttacggctggatcttctacctgagcaagttctacgaggtcctcgacaccttcatcatcctggccaagggcaagtacagctctactctgcagacttaccaccacgccggtgccatgatgtgcatgtgggctggcatgcggtatatggccatccccatctggatcttctgcctctttaactccttcatccactctttgatgtacacctactacactctctcggccttctctgtcagagtccccacggccctgaagcgttccctgacctccatgcaaatcacccaattcatcattggagctacattcgccatggtcccatctttcgtcacatacgtttcccccatcacctctacccacgtcgtcaccgaagagtctcccgtcaccaggagcgccccgatcgactacatcatcccgactgccgtcagtgccctggattcgctcaagcagctcatctttggatctgccgaggtcgctggcgccgc

SEQ ID NO: 7459 - DNA, 1490 bp, Trichoderma harzianum
ccttcattctcattgtcgacatccatcgtgattcccctgaaactgcgtctttcagttgactctggtgattctctgaggcgccgaggctctgtgtgagcatcccgatccaacatcatggcgatacgcgaggaaatcgtggcgtctgcagcgcaatttctacaagatcccagcgttgccacctcgtccgtcgagaacaaaatctcgtttcttcgaaccaagaatctgacacaggaagagattgatgccgccattgccagagctgggggcggtagcggcgcggtagctcctagggctccctatgctggcgcgcctcagggtcctcctcagggtcctcctcaacagtattaccaatcctacccccagtatgcgtggcagccgcctgcgtcaacacaacgggattggagagattggttcatcatggcaaccgtggttggaggggtcagctatggcctgtactcattgggcaagcgttatgtatacccccttgtagcgccacctacccctgaaaagctggagcaggacaagaagtcgatcgaggagcagtttgacaaggcctttgctctggttgagcagctgtccaaggacacagaggcactaaaggatgccgagaagcagcggacagaacgactggacattacactggcagacctggacacgatcatgacggagctgaaatcagcaaacaagcgccgggaagacgacgcgcagcgcattcgcgacgaagtacagagcctcaaggacgccatcccaagggccatgaacaaccaaaaggagctcaccgacaaccgacttgccgaaatcaacactgaacttgccagcctcaagactcttgtgtcacagaggatgaatgctaactcaaataactctatgtcgagcggctacttccgaggcaacaatggagtcaacggtgtcaacggatcgaatggcgtcaacggaactagcggggcggcttcacccacgacagcacccgggcaatcagtaactgccccacccatcgacagtgctacggaggcgagcggcactcccaagcctgatgctggcaagggcccggctcagaacagatttaacagagcgtctggcctgtccgttggctccggagccaaggcgtcaatcccagcatggcagatggccatggccaaccaaaatgccggatcagcaggctcttcgtcgggcaaggagcccgaaaaggccgccaccgaggccgcggccagcagctcgtaaataattgcttgcttgacttgagattctccatgcattgtacgattttgatcaacttgcggttattgttgcgctacgtacgtacggataaagggacaatgcagacatcgattggataacggccggagcgttggttgctctatcaaagttttttatgtatttaatatcaaatggaccacatatacttttttatctattttccggttggattacatgttattattattagaagaaaaagaaaaagaagaagctacctacacaaaaaaaaaaaa

SEQ ID NO: 7460 - DNA, 834 bp, Trichoderma harzianum
agactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacgtcggcaggccaagggcacatcttggaggatgaacttcttccgaaccgtcgtcagccctgagatttaccctaatcagactcttggtggatggtcgccgccagaccaggcgagcttccatattacaaagttctttggtcatgtcaagtttatttgatcgggaggatttgggtttacgattgatgtttgcgagccgtaaagcggaattacaaagcacatgtacataatgcggcatgcctgatctaatgtaattgtcaatgatgaatgatctgacacaaaaaaaaaaaaaaaa

SEQ ID NO: 7461 - DNA, 734 bp, Trichoderma harzianum
gacccacgcgtccgcccacgcgtccgcgcccataaccagcaatcatgttctgtctccgaagctggctcccgctcctcttcatcccgacaaacgcctcgcccgccttcatcctcctcttcttcatctgcacctacttcctcaaccgcccctgcgtctactgctccgtcctcctcctcatcctcttcctcacctcgtgcaactggtccgaccgctgcttcttcgacctcagcagcaactggttcctccctcgacctccttcgtccctccagctccccgtcgacgatcaagactcgcacgccctcgccctcgccttcaacgacaccctcgtcgacatggtcaattctacagccaaagccgctgcccgcgccgctgcggaggaggtcgctgtgctgcgcaacgagtggactggcttgggcgtcgagtggctgcgtaatttgctgggcaagcgggagtggaggatcgactgcatggacatttacatcaggttgtaaaacgaaggggaattacatacatggagcttttatgaggggaagaaaacaaatattgtaatgaaaaacttcatctacctttgtgcattggataggctttagaacggcgggactgttgagaaatcatcttgggctcttcatcatttttttttacagcggcatggggtttgaacatgtggatatagcgcttgtctttctgtcgattttctctaataatatacatccatatatatactaaaaaaaaaa

SEQ ID NO: 7462 - DNA, 556 bp, Trichoderma harzianum
aagcattcgcctctcgttcagatctcaagacaaaaagcactcaaaccaatcactcaacctcttcaagaccacctttcaaaacaaaccttcaacatgaagttcaccgccgttgcctttgccgccctcgctactctggctacagccagccctcaccctcctcctcctcacggttgcaagcctgctacctactcttgccttcccaacgacagcggttggcaagtgtgcagcactgccggtcagtgggtgtttgctggcacctgccctcccaagactgtctgcaagttcgacagccaaaatggcagcccctactgcgttccccccaacttcaccatcccataaatccattaaatggggatcaacggggctacttacaaaagcctaccggatgagcatgagatttagagtttttggttgctaagacgtttcgtggcctgtcattgtcttgcagatcaatcctggacataaagtttacacataacatatggtacactcctttgaatgcgatgtatctctatagctatatgaatacaataaattgaagcaaaaaaaaaaaaaa

SEQ ID NO: 7463 - DNA, 1055 bp, Trichoderma harzianum
aggtaaccaccagcacacgcaaacgatacgaaaaaccgagaacaagtataccttcagctccgcggacaacaatcatcaccgcggacaacaatcgtcactgcacgtctgcctagttgagagttccaagtgtaaaaacatcagcagttgccttgctgcgtggttcccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcgcttaacattcaacggcgatcagcgggaggcaatacaaaccaaatatcaagcactggaaaacgagctgcgaaaggaaggtctggagaagagcatatgggcgggctggaggattgaaaaggcagctggtgaggaagacaaggaagatttgattgtattctggactggcgatgttccgaagaaacgactggaaggattggcgagcctcgccctcaagaaagatcatcgccgcttcaggcacgtcgtgtaaataggcatcaccgagtaaccgggggggctccctttcttcaggtagcatagccggcacaagaaagacatcgggctcaccagattttggtgtgcgattgttgctttttgtgtctcaaatcgttattttttgaaaaaaaaaaaaaaa

SEQ ID NO: 7464 - DNA, 1631 bp, Trichoderma harzianum
ggcggctgcgtcttctcacagcgcataattccgtcgcagaaaatacaagctacctacctaggtattgtgaggaatgtgcaatggtaagtccctaagtactaacagaggttgaattgctactaataagggagtggctattccacatccccggatggagtatcctcagtcgcatatactattctcacataacagtggatgcctagatacctatagtattacactctttcagccagctcttcgccagcattatatcctgaaaaaaaggagctatagcatatatgcatgcaccagcagaaatcatcatcacaccaatctccgtcttagcccccaccacctgtcctcttcatcgtcaatgacatgtagcagaatgctcagcctcatgtcggcatcgagtccggcctggcgccgcttctcactttcttcattatacctttcgaccgcatgaatgatcgccatcttgcttcgtctcggccccaaccactcaagcgcggccctacctgaaatatatgtgtcgtcctcacatacccccttgtaagtgccagtgtggaggaacgcgtcgttgtcatgctcatgctcgggagttggagctgtactttccatctccatgaatgattccagagtcgtctcttgcggtacatcttgtggcacctcttgagatggggcgtcctgtggattgtcctcttccgcgtcctcatcatcctctgtatccagcatttcatttgtcggacagacagtgtacaattcctttagcccgctgaaccaccgactgatggcatcttgagtctcatgtatgtaaccgggaccccagtcgagggccaacttttgaacattatgcatccaactggtcctggccaccgctttttcgtacatatgaggatgagctgttttcaaggattgcagacgagtccagctactcatgtcactgcttggccaaccgacatagatcatgtctctggcggccttgtatctcacgacacaggtggggctatagggacaaccccggaatgagttatagccccatatggtgatctcattgggcaggatattctctagaatcaaggctcgatgtgctcggctgacagagacggcagctcgacctgcagccgttgaccgggcgagagcaggagtaaccactaccctgccgtgattccgggttgtgactcgtaagaccctgtgggttccgatgacgctctcccatattttaataaggggttcggtagggaggttgttgaatgacggcacaagtctatcttgccctgtcgacattaagttgtcgtgtgccctttctggattgagatacacagtatagtgatgagtcgtaggaccgtgatatctagccagggcggtgctctgtctggattaggacagacagtgtggcggcgagtcatagggcagcggcatctagacgggggcgccatggagcatgaatttcgaagttgtctatatggtagtgagagttgggaagagtagatgagagagaagaaggggcacgggggaaacaagatgaccatttaaatatataggcccctattataatgcacattgtctggaaagcttcgagtctacggcagttttatagtttcaagtcatatagatatataattaacaactgctctgacgaaaaaaaaaaa

SEQ ID NO: 7465 - DNA, 1535 bp, Trichoderma harzianum
gacgctcaacgcaaaaatgtcggatctcagcaacaagaagagaaagcgagacggggaaaaggccggttctgcgaagaaaaaggtcgttattgacgcaccggcttcaattgcaaccgtctcctctgttctccggccgaaatcatgccctcctgtgattgcaaacactccaggaatggaaatgccctcgaatctggtctttaactcatatattcccaagaatgcctcttcaaagtccaaaaaggcagccgacaaggcactcctgctgcactccacgacgcaccggaatctggactatacggcaagagaagaagagtcgcgcgactcaaagccgctcctgaaccacttcatcggcatctacgatcccaagactggcaaattgcaagttgtcgaagcgaaaaagatggtcgtacgaggcgccgtccgctctaagcaagtgccgacttctgcagatcagacggaagccaagaagagcatcatggaccagaggacagaccttggacagacttttggaacgaagaaggccaagaaggttatccaagataaggtgttgaacgccatcgctccgcagaaaaaacctggcgacttcagcacacccaagttggatgacgcctccaaggccattctcaactccatcggcgcagtcacatccacaatggcctcaagagaagagctgcaggcagtcatcgacgaagccaagccagtacccaaggcgaatctcgacgcagaagacatttacgacgtataccgccccgaggaaatcatcggagcagatatcctcaatctggttcctattcgagaatggcaagagaaggctaaacatggcgagagcatccagttccgctcccgatatgtcgtctctcgcgtgcaagccattgcctccaacgaagatgccgagatgcggctgcgtgtgctaagatacctctctatcgtcctcctgttctatctctactcaaaacccggtcgccaaaagggcactcggcagttgccgccccgagagaagctccgggagctgcttgctccagcccctgaggcggtcgttgaaaatattcgtcgcaagttttcggataacggccaactgaggaaattccacattgacctgcttattgcacactgctgcgcacttgcctgcatcgtggataactttgaggtggacacgcagaacctgagagacgacctgaggatagagcaaaaggtgattaaccagtacttccacgagatcggagccagggtgaagcctgtaaaggacaaggcggaggatcgaatgctgcacatcgcaaagcttgcgctaccgttagactttccgaaacagcgacagatcagagcgcgtcgataatggatataatttgcacgaaggatctggaaaagtaattaaaagacagagatgtgaagggtttttacaaatggggaggagttttgattctacgagcgggcgctgtgagatatatatacatatttcccattgttcgacttctctcactgcatagaggcgtcgtttttttcagaaatacacacagtttcgcattccaaaaaaaaaa

SEQ ID NO: 7466 - DNA, 1983 bp, Trichoderma harzianum
ggagcgagattcaccacgggacaccgagtaggaaagggtgatgacggtgttgcggagactgagggtggtattctcttgcccgagtatcacaggagaattcccgcggatggactgtcggtgtacacagagggcatctgggatcaaatcgtgaacaacaaggacctggatctgccgacgcaacaagagcttctagctcagttccgatgtgacgagatctctcgagaagtcctggttgcctttgacctacttctgaccccacttgaggagcagcaggcccaagcctctaagctcggcaaggccattgtgcttcccgatctgggcaccacagctagccaggcccgtgaaaaatgcttcagagcttttgaggtgcaggctagtcgataccacaaaggcgtctacacccgcaagaagcaggagctggagagcaaggttgacggtcgactcaagaccctattccaaggacagattgcagcagctcacaaagccggagtcacggcctttagcgaagccgtttcaaacaaggtaaaggccgggcaaaaggccggtggagcttatgaatttgccgaaatcgtctccaacgagaagaagaagactacggaaattttcaaggcagaggtagacagccttgcgattgagggcgtcgagtggaccaactttgtgtcccagaaccagctctttgaggctgaactcgatgaggttagcagcaagctgcgcaaggacgaaatccgccggttagccacgcgggtggagcgttgggtcaagtccggttgggcgatgccgtcggcctagagttcaacaagctaggatccggcagaggaggctcgggagcgcccgaggaaggccaaaagccggcgacggaaaaggatctctgggaccgaatctggaaagtctttaccggaatagtcagcgaagccgagacccggtttgctgaccgagccaagagcttcgatgccagcgattctgaagtcgaagttggcctgtggcgcctccgacgtaagagctggacggctctccgagagaagattgaggaggaggtcatggagggcaacatcctcttgaagcttagggagaacttcgaggacaagttccgatacgacgatgctggtgtgccgcgcatctggaggccaacggacgacatcgagggtatctatacaaaagcgcgagagtctacgctcacattaataccccttctttccaagttcaagctgctgtctaacaacgcttctccggatctaattggattcattggcgtgcagcctgccggagttgaagctggcgacgaagaggatctcgctcctatcggcggcgtcgatgaagaagagggtaagagccttgaggaggagatgacagtgctaagtgagaataagcgacaagacctagtcgtgcgcttcaagaagacagccgatggcgtctatgtcgaggccaagcgaagcgccattggcggcatgacccaagtgccatggtacttttatgtgctgctcctcgttctcggctggaacgaaatctggatggttctgcgcaatccgctcatgtttattcttctcatcttgcttggtggaggaacttacactgcctggtacctcaacctgctgggccctatgatgcaaatgggcaacgccgctgtcactcagggcatggatattgctaagcagcagctgcgcgagtttgtcaacaactcagacactgcccgacaggctctggccatgcccgcgaggcaagacagcgacatcagcatggacacgctggatagccgtggaaagaagaagactgagtctgaaagcctggatgacatttagatgtgaaacggaaaagataaaaggaacccggaggcgacacatgagaagaataaaagcgccctttgtataaattctcgagacattgtcggacattggcggacacaagagcgaatagcattgatgagcgaacaggatacgaataatgtctacacaagataaaataaagctgatttatccaaaaaaaaaa

SEQ ID NO: 7467 - DNA, 1086 bp, Trichoderma harzianum
caaaaaggctccaggcatcgtctttgacaaggaggactacactgctcgctacaactggtcaattccgctacgttcatacgcggaagaaaaagaacatgtcgctaacagcaatcgcaacaacaatgcagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcagggcaagttcccggcaagccgagggaccatcattatcatgtcactggtggcattggccctcatgattttgtctctagtggtggtcattgtcatccggccatcatagaggctttggacagctatggaatcaccgacttttgactgttgattttcagttggttcctttttggaatgaagaaggatctatgggcttggtacttgtgatttaggatagcattgggtttgaagcatgtgattaacgggttttggtgttttggactttgcagggtaaatgtttggatcatatatgcatcgatgtacatttgcaatggatagaggatatctcttcactgataaaaaaaaaaaaa

SEQ ID NO: 7468 - DNA, 1451 bp, Trichoderma harzianum
gattgtccttcttccagctgccaaaatgttgaatccgctcaaggccaactcgcgcgtccttcgcagggcctccatccggagactggctcagccgtccgtctccgtcatctccaatcccatccggagcgcgggaagcctctcgcaacggcccaattcgggatttgtgtcgttccccggcgctctcaagagctccttcaccagctctctcaagtttgagacgcccgaatcatacacagccctgccgacgtacagagtcgtggaccagaatggccaagtggttgacccctccttcacccctgacatcagcgatgaggccgtcatcaagctgtacaaggatatgctgtacatctccatcatggatctcatcatgtttgatgctcagagacagggccgactaagcttttacatggtaagcgctggcgaggaagccgtgagcgttggcacctcgagtgtgctggacaaggatgatcccgtcttctgccagtatcgagagcaggggctgttcaaggagaggggcttcacgacggaacaattcatgtcacagctgtttgccaacagaaacgacaacggccggggcaggaacatgcccattcactacggatgcaagccgttgaacattcacactgtctcctcgccattggctacacaacttccgcaggattcgggggcggcttatgccttgaagctacagagactacaagaccccagctcgaagccaagagtagcggcagtctttttcggagagggagctgccagtgagggcgatttccatgccgcgctgaacattgccgccacacgctcttgtcccgttgtcttcatctgccgcaacaacggattcgccatttccacacccactctcgatcagtaccgaggagacggcattgcgagcagaggaattggctatggaattgataccattcgaattgacggaaacgacatctgggcagtcagagaagccacaaagaaggcacgagaaatggcactgcaggacggtggcaagccggtgcttattgaagccatgacctatcgtgtctctcatcacagtacttccgacgactcgtttgcataccgagcccgtgtcgaagtcgaggactggaagcgacgagacaatcctattactcgactaaggaagtggatggaggccaaaggatgctgggacgaggccaaggaaaaggaggccagacacagcctgaggaaggaaatcctcaagggattcagcgaagcagagcgagagaagaagccgcccattggctccatgtttgaggacgtttatgaaagtctgacgcccgacctcaaggagcagatgggacagctcaaggaattgctagaaacataccccgaggagtatgatgttgcctcgtacgagggcggagtagcgagcttggatgtaccaaaggacaattaagctattgatagatgagcgtttctgtgttttttaaatagtttgaaga

SEQ ID NO: 7469 - DNA, 1774 bp, Trichoderma harzianum
gctgggttgagcctttttgcgcatcttgacctatatttacaccttagaacgacgcatatacatattcctaaacattacgcttatggcggttgataccgaggggtccgccatcaacattcctgctcccgcagctgccatgggactcacccaaacgcctggaaaaggcgctgcgagccacgatcttcacccgtcgggcaagcgggctcacggccgaggagtgcagatacttcgaggcctggctctcgctgtgtactttttaatctgctgtgtgactattgtcgcttcgcaagttcttgggtgttggctgtatttcgtgaaccgcgagatatactacgattacatggccttgaccaaacggtggtttgccatagtcgtaacttggatgacacagatttggggcccggtaatcatccgaatcagcggcgatgagtcagtcgcgggagagatccgtcccacggacggtggcggagtgcagttcaactttcctgagcggttggtgatgatagcgaaccaccagatttataccgactggttgtacctctggtgggttggctacgtcaaccgagcttcggcgcacggccacatttacatcattctgaagcagtcactgcagtatattcccatcatcggctggggcatgactttttacagcttcatcttcatgtctcgcaaaatggcaacagatcagccccggctggcctaccgactgaagaagctgaagcagaccaggaccgatcccagtgggaaggagtatcgcatacccatgtggctactgctgttccctgaaggcaccaacatttctggaaatggtcgacgaaagtctgctagctgggcagaaaagaaagggtggaaagaccctgagcacgtgctgctccctcgtagcactggcagcttcttttgtctcaacgaactcagaggaacggtcgaatacgtctacgactgtacagtggcgtatgaaggtgttgggcgaggcaaatacggcgagaacatcttcacactctctagtacctacctccagggccgaccacccaagtccgtcaacttctactggcgaaaattcaagctttcagatattccacttgatgacgcagacgaattcgatgcctggctgcgtgcagagtggtacaagaaggacgcattgatggaacagtacctgaccacaggacgattccctaccatggccggatccaagatcgactttatcgagaccaaggtccaaacgaagactccattggagatcctccaggttttctccgttgtcggcattgctggtctcgtctggcacaatttgcagcgatttggaggtgcggtcggaagaaggttcggcttctttgtgtagaatgaaggtttgtcggtttgaggttgtcgaatggagaaggtttttttccattggcacctcacctttaacccctttcctaagagcgtttggcgatgtttgtggatttcattagcgctagtatggtatgctttctggcacggatttagtattttcttcttggataaccaatggggcaggataatcaagacggcgagtacagaagattaactgcagacttttgggcgtcttctgctgctggtgcggagttttgaggagggactttgccttgggtgaatcatgaattaccgaggcatcgcgtatcatggtgaacggaaggaatcgggtttgactgggcttggcttgtttggcttgggttgattggattctattggatttagtaccactttacaagtggcaatagtagataatgaagcgttcttcattggaaaaaaaaaa

SEQ ID NO: 7470 - DNA, 827 bp, Trichoderma harzianum
atcatcagctacaaagacatctactcatctacacacaaacaaacattcaaaaagcatcatcacacaaagcttccaaagctccagcttctcaacaatccactattctctacacttcaaaccacaacaaccacaaccaaaaccttcaaaatgttcgtcggtgacctcgtccacttccgcgctgctctcagcaacggcatcacccacgagatgattctctgcccctcagccgccacttctcccgccacctccgccgcaaacaccccagacaaccgctccctcgcctcggagaagaagaagaagcgtttctcctctttcttctcccgccctcgcccttctgtcaaggccgccaacgtcggtgctggcatgaagctgcccatgaacattgcctaaataaaaccaatctttcacaccaacaaaacaactacaacaatgtgctcctgaactgcggatataaagaggaatggatgaaccggtctatgcccagcacgatggaataaaatacacaaaacacacaaacacaaaaaacacactcctttaagagacgacgaccaacgaaacaacaacacctaaaagtttttttgctttttccgacactacttttttctttctcttttgtcacaagtttttttgggcatggattttttttacacacagggcaggctgggagcacaaaaaagtttttatgagtattagattctatacccatttgattcgagaaaacgcaatgatacaaaagggggagaggtatcagggaagaagaggggtggattaagacatagacacactacattttaataatatataatctcattccccaaaaaaaaaaa

SEQ ID NO: 7471 - DNA, 1071 bp, Trichoderma harzianum
attacaacatatatacccatcatgactatgtggggttggattcacgcgatagcagactatttgctgtcctgggtgaaactcgagcaaaatgcggaaattgggtggcgttcgttcaatcgaaagaccggaaagttagagcgcgaacaacagacactgtggaagaagctcaagcttctcgtcttatttaacccactcatggaatggattgataggagtcaactcatgcgtttatacatgcatgaagagtcaattgcagaagggcgaagagaaagaacaacgagttccaggaggcgcatcaaggctttcgttgacgcctatggaataaacatgcatgatttcgagccctctgatatcagtcgctatcctacctttgaagatttcttcactcgttcactcaaaacagagtcgcgtcccatttgtaatgttgacgacccttcccatgccgtcgtggtggctgactcgagagtcgtcgtcttcaattccattggggaagcaaaagcgttgtggatcaaaggcaagaactttagcctcaatgatctagtcatgagcaatgaagtaggtgataagtttagagacgctgccattgcgagctttcggctttcaccgcaggactaccaccggtaccactcacctgtccagggtacaatccaaagcttccagagcttaccgggcgattactaccaggtcgatcctatagctttacaaagcaaggtggatatattaacacgcaatagacgggatttcgttgtaattgagacgaaggagtttggggaagttctatttgtggcgattggtgcgacggacgtcggaagcgtgcgtatccacgagaaatatcagagggccgggcaaacagttaagaaaggagatgaactgggcgtttttcagtttggaggctcatctattattgttgcttttcaacgtggcagtatcaaatttgacgatgatctgttgggactgagtgagcagaaaatccagacgtctgtggaggttggtatgagcctggggtgttctacgtgagaggtttcagacagggtcttacatgaatatatgagaaactttgcaaaaaaaaaa

SEQ ID NO: 7472 - DNA, 1511 bp, Trichoderma harzianum
cattcgcccatcatgtcggctagaatcccagctcttgtttcagcacacgtcagcgaggcggcgcgacagaagattgacattgtcgccaagtttgtcgaggaagaatgcatccccgccgatcccgtacttgaagcccaggttggcgaaggcgataaccgctgggagaaccacccgtccatcatcgaggagctcaaggacaaggcacgcaagctgggcttgtggaacatgttcctgcccaagggcttctacgccgagtctcccggctggaccaacctcgagtatgccctcatggcagagtggctgggccgctcgcgcagcgcctcggaggcgtgcaactgcgctgctcccgatacaggcaacatggaggtggtggccaagtacggcaatgccgcgcagaaggaggagtggttgaagcccctgatggagggcaagattcgctcggctttcctgatgactgagcccgaagtcgcgtcatcggatgccaccaacattcagctccagatcactcgcgacggcgaccactacgtcctcaatggctccaagtggtggtccagcggtgccggcgacccgcgatgcaaactctacatcgtcatgggcaagactgatcccaacaacaaggatccttacaagcagcagtcagtcatcctggtccctgctggtctgcctggcatcaccatcaagagaatgctcaaggtctacggctacgacgacgctccccacggccacggccacatcaccttcaacaacgtgcgcgttccggccaagaacctggtgctcggcgagggccgcggattcgagattatccagggccgactgggacctggacgtatccaccacgctatgcgtagcattggcgctgctgagcaagctctcgactggatgctcacgcgcgtcaacgacgaaaacaagaagccttttggcaagctcctgcgcgaacacggcgttatcctcgaatggattgccaagtcgcgtattgagatcgatgcagcacgcctcatcgtcctcaacgccgccgtcaagatggaccaagagggccccaagaaggctctcacggagattgccgaggccaaggtcctcattccccagaccgccctgaacgtcattgaccgcgccgtccaggcatacggcggtgccggtgtctctcaggagactcccctggccaacatgtgggctggcatccgaacgcttcgtctggccgacggccctgatgaggtgcatctgcagcagatgggccgcaacgagaacaagcgcggcaaggagacggcggccaagctcaagtggcagaaggccaagacggcggagctgttgaagagatacggcgttgagcttgccgagcctggcaccaaaatcaagcacgctgccaagttgtaatgaaagaatggctggtctgtttagattgtcttgttttgaactgtcattggtttgtaaaatacgggaactagggtaatctcgagatgttgcattgcaaatagcgtatatatattataactcacttcatgaaaaaaaaaaaa

SEQ ID NO: 7473 - DNA, 1640 bp, Trichoderma harzianum
cccggaacaaggcctttttggtcatcgcttcatttcgcatatcggcgccattcgttctttccacctactgacatacaaacgcaccttattttctttcattcttactcttttcgtccagccatccgctctctttgtcttggcctcatcaccggtagcttcctgacagtaattcgcccgtctagcctgccgtcttgcccatcaaaagacaaagcgccaggaggggagaaccccagtatcgcgtctaccagccctgcggcttcgattcggctcaaccatccatctatctcggcggcgtcaaagacaagctccgacgaatccaactaaccagagcaccgagtctttgctctgcgtcaacttgaactcagctctctccttcgtctatcttacgcttcgagatattcatcatgtattcttcaaggcttatttcggtactggtcgtggtggtgtccatcctctgcatggcccaggccacttggtgggacaaccaaaaagttcaccaccgaggattgattcgacgagcggattccatttccgaggctctgaatggcttgaccggctcttcaagcccgagtagtccacccccagaatcctcaactccatcgccgccaccggcccaaagttccagctctccgtctgctgatcctacatcctccgatgaaggacaatcaagcacctctgctcctccatcttctacgccacctcccgactcatcttcttctacaactcctgcccctggcggcacaaccagttctccttcttccacctcggctggctctacaagtgctccttctgactcgaccacaccgtccgcctctgctccatccacaacacctcccccccaaagcacctcgtctagcgataaggggagcagcgagaacacgaccagcgctggaggagacaacaaggatggatcttctaataagtcggaacagcaaactacctatgtctcaaccaaggtcgaagttgttgtcaagaccaactctgatggctctaagcaaacccaaactaccacgacaaggaccaccgagactgcagcccttaacgccgagaactctaaagctactggcatgtcggttcagacccgtaacactattatcggtgtcgtcgtcggtgttggcggtgccatcatcctcggcaccctcattctggtcgccttccgagtctggggccgcaagaagcatgccgaggaagccgatggcctcatggcttacaacgccgacatcgttgccgccgagaagtctccccgaggtagttcatcgggtggccagcggaatccgttccagtcgacgctggagaactaccaccagccagtaaatgcgtcggccaacttttaagatttttttgggcggtgagatttcttttgcagctgttgcggcatgcggatatggtccaccccaaagcatgggttacgatgtatgtcgaaaagatttgacaggcgatgctgcagacttttggaagagagcgagaagaaggattaaaaaaggaagaattctgagcgaggctactgcatagcgagcccttttatttttctgttgctttgcatatagaattgatactgtttataaggaaagaaagcgtgatacctacctaattacttggaacactgaatatacacatttttttactaaaaaaaaaaaaaa

SEQ ID NO: 7474 - DNA, 1027 bp, Trichoderma harzianum
cagcaaacacccaagcaacaacaaaagcaaagcactccagcaacaaacatctacccacctcacaacaacatcaaccaacctgacaacttcttcacaactccacaaacaacaacactcaaccatcacaatggctttcttccctcgcactttctaccaccccaccgaggcctctttcacgcctctcttccgtctccttgacgactttgacagctacagccgacagaatggcaaaagccgctctgttcgccgccagcaagttccccagtggcagcccaagtttgacgtgcgcgagaccaccgaggcctacgagctccacggcgaacttcctggcataagcaaggagaacatccagatcgaattctctgacgcccagaccttggttgttcgcggcaagactgagcgcacatacactgcgggcacatcaccctctgcttccgtcgaaaacactccttctacagagactgtcgctgaaaaggccgagtctgaacgcaggaactcgcaccaggcgactgttgaggacgaagacgaggccagcgagcgcgagtcgggctatgaagtcgtgaccaccgaggaagagaagaagcctgaggccaagactccccaacagcccgccgacaaggccaagtactggctcaccgagcgcagcattggccagttctcgcgcagcttccacttccctggtctggttgagcacgacgctgtcagtgccagcttccaggacggcattctgagcatcaccgttcccaaggcgaagcacgaagcccaccgaatcttcatccagtaaaccatttcacaaatcggaaaagacactatctcacaacaatgtaatactactacaatctaccttgggattagctttgctgtctgcctttctcgattgcatcaatgggagttggggggatttgggatcaacggataattttcaacgtgtgcactttttttctggaactggcttgcttttggtaactagcatatagagcatttactgcaataatacactctttttcgtattaaaaaaaaaaaaaaa

SEQ ID NO: 7475 - DNA, 1064 bp, Trichoderma harzianum
atcctttttctttcttcaatatcgcctcaaatctcactgcaactctctcccctctgcggcatcttcaccatggctgaaccaacccccggcctcactcccgagcagctctcggccttccaaaaagacggctatctcatcatccgcaacgccctcaagccagaaaccgtctcatcgctccttagcgaaacaaagggcctgctcgagggcttctccctcaaggaccacccgctgactcgcttctccacgggcgagaagtcggaccacgtgggcgacgactacttcctcacgtcgggcgacaagatccgcttcttcttcgaggaggacgcctttgacgacgcgggcaacctgaccaagcccaaggagcgcgccgtcaacaaaatcggacacggcctgcacgtgcactcgccgccgtttgcgcggctcattgacgaggcgtcgacgcgggccgcgggcgaagtgagtcctgcggctgtggctcgtgatctcgggttcaaggatgcgcggtgtctgcagagcatggtgatttgcaagcagcccgagatcgggggcgcggtgccgccgcaccaggactcgacgtttttgtacacgagcgcgccgtcggccgtgggcttctggtatgcgctggaggacgcgacgctggagaatgggtgcttgagtttcttgccggggtcgcatcgctgggcgcccgtggagaagaggctggtgcgcaaggcgggaggtacgggcacagagattgttgacaatgatgggctcaagtttcctcctggagaggagtatggcggggagcagctggatggggagtatatccccggtgaggtcaaggcgggtgatctggttttgattcatggtaacatgctgcataagagcgagaggaacacgagtcagaaaggtcgtatcatttacacgtttcacatcattgagggcgagggaaggacgtatgatgagaggaattggctgcagccgccgaaggagggcttcaccaagttgtatgcctagaatcagcctgctgggggaaaggaatttatcagatcaatgcttcctttttttgttaaaaaaaaaaaaaa

SEQ ID NO: 7476 - DNA, 979 bp, Trichoderma harzianum
acccacgcgtccgcgacctgtaactgggtacgtgcctacatgtatatccggcatgccctcatgtaggtgacatctaaaccatgttcatgcggagcatctcgacggcgcctatctgctcctatgaacggccaaccctatacacatcgtactctgtacacagtacatgtacgcaactacagtaaaacgacatggtagtatcccgtggtggccatccatgggctactctctgtatgctttataggcccggaataggatcccgcggagccggaaaccgtggggatggaaggctgtgcaaagactacatgtatagtttacggctcagaattgttggccggaagcttgttgtcgttacgggagagagaccgatgtgacaagctcccctcgagtcaagacctcttcatttcatattcaccaacgctggataaggtactgtaaatgaactcaggtgtgctctcaggttcacatttacaggaatcatgccctccacactctcggggcatttacacggcccgaagagaatgaagaaggagtgtgtgctctcctatctggataacggggtttcattgtgggcatcttatgcctgcatggatagcatatgatgccccagcctctgcaagaaagacaaccgtagctttcgcgcgcgggttctttaccgttttgattcttcaacggcggcgccactctgaagccagcgcttccttgccgaagtacggagacacactctctgccgggctgaaagcacaccccttcgattctggctaaagcaaacattatgaccaaccaacagcccaaatccagcaacactttgtgatgaggaccatgaacgacaaatctccggcccagaaaaactcgtgtggtacccttaaagccggctggtccgacgacactgtcgtcacctcgaggctcccagcaaacacacaccttcaagatacacatcagctagccaaacaaacatattcctctaaaaaaaaaaaaaaaa

SEQ ID NO: 7477 - DNA, 866 bp, Trichoderma harzianum
aggagcgattggtctccgagaccaagaagctcactcagggcgtcccctgggaccactccaacttcatgggccccgtgattcacgaggcttccttcaagaagctctcgggtgccattgacgaggccaagagcgacaaggacctcgagctcgtctttggcggcacctacgactcgtccaagggctactttgtccagcccaccatctaccaggccatcagcccttcccacaagttcctctccaccgagttcttcggccccatcctcaccgtgcacgtctacgacgatgccgcgcccgatgcctttgccaaggtctgcgagctggtcgatggcacctccgagtatggcctcaccggatccgtctttgccaacgaccgcgaggccgtgcgctttgccgaggagaagctgcgcaacgcggcgggcaacttttacatcaactgcaagagcaccggtgctgttgtcggacagcagccgtttggtggtgccagggccagcggcacagacgacaaggccggtagtcccaacctgctgacgaggttcgtcaacatccggtcaattaaggaggagtttgcggccacgacacaggtatcatatcctagcaacgaggtttaaaccaatccgccgacacctgcatgatggactgggaggaatgtgtaagaggggtgtaaggttgatgatgtatggcgttgatgtttctccattttgagtctgtaatttctttgcatctagggtaggatgctggcgttgagcgacgggaatcgtcgacatgcataatctcccgtattgggagaaacccatcaaaaccacattgatgatattgatgttaaattgaaaccaattgaaaccaattgatgaaaaaaaaaaaaaaaa

SEQ ID NO: 7478 - DNA, 854 bp, Trichoderma harzianum
ctttgtcatgttgtaatgcaggatcacgattaatcttttcttcttctctcaacacacggccatgcggcgtgagagggatgactcagacgatgaagacattccgctgcatcacaaacgcccgtttggcgctgggctgaagcgcaagaaaattgagtttgtcaaagccacagacgcagacgcaagcaacacgatcaagaatctgggcaaggaaaccgcctctatcggagatgtctacgccagcatagtcctaggcggcagctccagggattcatcatcaaaacctgaaggcaccagcgatgaaaaggacgaccaaaaggaggacgctgttgaaaaagagccggaacctccaatatgtcccgtctgctctcttcccatcacaacgacgctgcagcaacacgaggcctcgcttgcccatcaagtcagcctggaacactcccaccctccatctgcactagatcgatcgcgcatgggtttgaaagccctggaatctcagggctgggatcccgattcccgtcttggcctgggccgagaaggcgagggcacccggttccccatcaaggtagccaggaaagaggacacgctgggaatcggggctactcgtacgcagccaaagcaggcggtccaagagaagcctcgggctctgactggcaaggaaatgcgcgctctggcggacaaggagagacgaaaaggggagaggctacaggctgagatctatggacgggtggatgtggagaagtatctcagggggaatggaggtgaggatggcttatgagaagtacaaagagcacaacgagacgaatgatagactgcagatggcctgggatatagatgtggttggaggaaaaaaaaaaaaa

SEQ ID NO: 7479 - DNA, 1160 bp, Trichoderma harzianum
ggaatagaaagacgatacacaagacaaggaatcagacaggacttgcacaagacatagatcacaagaaacgcgacctcacctcatcctcgacgatgcctttcaacacagagctcacccgccgcctgggcattcgcgtccccgtcatccagggcggcctcatgcacgtcggcaccgcagacctcgcgtccgcagtctccaacggcggcggcctgggcatcatcaccgccctcatctcccccacgcccgaagccctgcgcgccgagatccagcgctgccgcaccctcaccgacaagccctttggcgtcaacctgaccctcctcccgtccctcctcccgcccgactacccggcctacgcccaggccatcatcgacgagggcgtcaagattgtcgagacggccggaaactcgcccggcccggtgattcgccagctcaaggccgcgggcatcacggtgctgcacaagtgtacgacgattcgtcatgcccagagcgcgatcaagttgggcgtcgactttttgagcattgatgggtttgagtgcgcgggacatgttggcgagagcgacattacgaattttatcttgttgagcagggcgaggcagacgctgaatattccgtttattgcttcgggagggtttgctgatggccagggacttgcggcggcgctggtgttgggagcctgcggtatcaacatgggaacccgtttcgtagccacccaggaagcacctgtacataataatatcaaggaggccatcgtcaagggccaggagacggacacgacgctgttgttgagacgctggacgaacaccacgaggctgtacaagaacaaggtggcgacggatgcgctaaagattgagagggagagcaagtcaggcgaattctcggaagtagcaccttatgtcagcggaaagagagggaaggaggtcttcattaacggcgaccctgaatacggcgtctggacgacgggccaggtcatgggccttattcacgacatcccgacctgcggcgaactggttgctcgtattgaaaaggaggcggagactgcgctgagggagaagctggctttgattgtgtctgattcgaagctataaggaatgaagtaacggcatgggttcagtcgataataatgaatgaaatacggttcctttttaaaataaaaaaaaaaa

SEQ ID NO: 7480 - DNA, 668 bp, Trichoderma harzianum
cccacgcgtccgcagatggtggcgctcaaccatcccactcttgttcgcaagcttattctagctggaactgggcctagtgccggtgaaggtattgaaggtggtgatccggtcatttttgggcgtcttgcttcagcttcaaacgatgcagaagaaaagagcggctttttggagggcttttactccctgactgccaagaagcaatctcaaggcgggaactggtggaagcgtatgacaacggctcgccagaataggtctgattaccttggacctgaaggcaccaaggctcagatcgacgcagttcttcgctggtcgaaccctgaatatgtctctgagggctcatacaaccgtctgagcgagatcaagatccccgtcctcgtggccaacggcacccacagtcacagctgggtcatgttcaagagactgaccaacgctgatgcccatctccacttatacccggatgtgggacatgggttcttgaacgagtatgcaggccagttctctggccttgtcaaccagttcctagacgcttaagtgggaatcaggggttctttaaaggcgcgagtctatctatttatgggttgtgtggtttctattgggtctgggttatatataggcttcgtaactaaatttacttacaactgcatatgcttctataaaaaaaaaaaaag

SEQ ID NO: 7481 - DNA, 1383 bp, Trichoderma harzianum
aaaacccaaaaaaatcgccatcaattgcgccccggccagcgattccctgccaccgagacgagcctcctcgaaacccgccgcttctccctagagccgacccggtttcctctctctcactctctcctccctctccggtccaaccgccagactttcgctccataacccatcatggccccctcatcgcttgctcgccccatgctccgctcgccggccctgcgccagcttgccttccgccgcttcgagagctctgccgccagcaaggccaccgacgccgccaaagatgctgccggcaaggccaaggagtaccaggcaaaggctgcgcaggggctgtcgcgcgtcgcgggtgctgccggccctgccattgcccgagctgctcgtggcctcaccaacgcgctcggcaaggtcggtggacgcaccggcaagctcatcagcttcgttgagaagcaaacccctcaggtcgtctactacggcaaggttgccgtcgagactagcaagattgtcttccacgcccagaaaatgagccctccttccgttgccaccttccagaacttctaccagtccctgtggaagtccatccagagcggcgccattctcaagtctccccagaaccttctccagcaggcccgcagcctgactcctggccagctggctgctggtggtgtcatcttcgccgagtgcctgggtttcttcaccgttggcgagatgattggccgattcaagctgattggctaccgcggagagactgcttcgcaccactaaacgtgtctgcgaatgtctaattccttttaatgtttttaaaggaggtcaaaaatatcaataacccaagcctggtcccacccggccaaacttggttgatgctcgaagaatgagaactgtctgcgatagaggaagaaagaaaaaaaatctggagagtgaatgaagaatgatggcaagcacacacacatcacacgcataccatataggaaaaaaacatgaaaatcggcatgtacggatagacaaagaggaacggaatagagggaaacatggccgggtgtgacaacccccgactgacgaagcgagggatatctggtgtgaccaattggttggcagagaaaaaaaaagaagagcgagagaatgcgtggcgggcgagacgaggcgaggaacgggagggattaggaagaggtttgggcttggacatctggagaatccctctttttgcctcgtgtgtatacgtgtgagcaacttggtttttacctttttatctttttctttgttacaccccctttgtcacgcatacacccagctacaaccatgtacatcagagacttgcttgatgccatagcagcagaagcagcaatttaatccatgacgaaattcttcggatgttcaaggaaaaaaaaaaaa

SEQ ID NO: 7482 - DNA, 836 bp, Trichoderma harzianum
acggtcaccgctcaagggcttcctcgccgcagtcacgatgaagaacgggctattaccacccttgcgattccttcgcagcaccagcttcctgggcgcaaaccaggcacgatggcttcacaagacgaggccggctccgacaatcccacagcctagaccattcgtccccgacgtccagaccttcctcacgctcattggccgcggcctcaacaagcacgcctccaagttcccgtcatgggagtctctcttctccctcacctcgccacaactcaaggagcttggaatcgagcctccccgcagccgcagatacctgctgcagtggatgcagcgataccgaaagggtgcgctgggacctggcggagacttcaaatacgtcacagacggccaagctctgctgaaagtagcaacaccaccggcctctgttgtcagcgatgcgaaatatgtggtcaatgtgcctcaagaccaggaggcaggtctgggggattctgaaatccttcctcgacccaatggctacacagttagaggactcaagtcaatagcggggccgtttgcgacacccttgccgcaacaggccggtgcagtcgtcaaagttacggagggcatgtgggagcaacgccaaggacgcaagattgatggtggtgagagaagaagggcggagattcgcttcaagagacggtcggtagagcggagagctgagcgcgaggcggaagcgttgtccggcttctaaacaggaggacgcttgatggctagcgtattgtatattacgaaaactctgtaaccaattgttgttattctagtgctagcaatcgaagcattgccgtctcgaaaaaaaaaaaaaa

SEQ ID NO: 7483 - DNA, 636 bp, Trichoderma harzianum
cagcaaacaacaatacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacttatttccccatcatcggcgccatgcttggctggcccgtcctttgcaaatgggctttggacggacagatcggtcgcctgtaaagaggtgatagaggcaatggtatagagtgggacagcaaaaagaatatagagatgtccatctttcgactgtatatatacacttttgggcgtttggatgggactatgggtgcgaagcatatttcggcgcaacacagattaattcaatttggattctctttgttaatttaaaaaaaaaaaaaaa

SEQ ID NO: 7484 - DNA, 2015 bp, Trichoderma harzianum
gtcagcaatccgttcccagagaccgacaaatacctttcgacaggttgccatctcttctacccatcgcatcgccatggcaccgcctaaacgcaacagcagctcgctgcctgccggctatgtcgaggacaagtcgaagggcgcaatgctcagattccaagactcgcttcctcgcctcccagtcccgaccctcgaagagaccgccaagcggtatctcaagagcttacaccccataatctccgccagtgaactcgagaagagcacagcggccgtcaccgagttcatcaagcccggcggagttggcagcaaactccagcagaagctcgttgccaaggcccaagaccccaagacaaagaactggatgtacgagtggtggaacgatgctgcgtacctgagttaccgcgacccggtagtgccgtatgtcagctacttctactcgcacagagatgatcccaagcgacgcaaccctgccaagcgggctgcggcgctcaccagcgctgtcctcgagttcaagaagcttgtcgacagcggcagcctcgagccggagtacatgaagaaactgcccatttgcatggacagctacaagtggatgttcaacgcgagccgtgttgccgccaagcccgcggattatcccatcaagttctcccacgaggaaaacaagcacattgttgtgattcgcaagaaccagttcttcaagatcccccatgaagttgctggtaagcagctcaatgcctcagagcttgaggctcagttcaaccgtgtctaccaaatcgcaaagcgagtttcgcccgtgggagcgttgacgtcagaaaaccgagatgtctggacagatgcgcgtgagctgctgatttcagccagccccaagaacaaggcagccctggaggccattgagtcctcctctttcgtggtctgcctggacgatgcgtcccctgttaccttggaggagcgcgcccaccagtactggcatggcgatggcgccaaccgctggtatgacaagcctctccagttcattgtcaacgacaacggcacatcgggcttcatgggcgagcactcaatgatggatggcacgccgacacatcgcctgaacgactacatcaatgatctcatcttcagaaacaagattgatctttcagaccctagcgtccgatctgacttgcccgaacctcagcccatcaactttgacattacgcccgaaatccaaagcgaaatcgaccgtgccgttaccgacttcaacaacgtcattggacagcaccagcttgctgttcaggcgtaccaggcctacggcaagggcctcattaagcaattcaagtgctcaccagacgcatacgtacagatgatcatccagcttgcctacttcaagatgtacggcaagaaccgaccaacatatgaatctgctgccactcgacgcttccagctgggtcgtaccgagacgtgccgtagtgtttctgacgagtcagtcgcttggtgcaaatcaatggcagaccactcagtcgatgacaagtcgcgagtcgacctgttccgaaaagccattgcggctcacatcgagtacatctccgccgcctcagatggaaagggcgttgacaggcacctctttggactcaagaagctccttgagcctggtgaggaagtcccggccatctacaaggatcccgcatacggctactcttcgtcgtggtatctatctacttcgcagctcagctccgagttcttcaacggctacggatggagtcaggtgattgatggaggatttggaattgcctacatgatcaatgagaacagcatcaacttcaacgttgtatcaaagggtcttggaagcgagcggatgagctactatcttaacgaggcagcgggcgagatgcgagatttgctggttcctacactggagccccccaaggccaagctataaaggtctttgttatacatacacatacattactgtatagactcttcctttattaggcgctgcacgtttggtataaatgtagatataatacaccattgcgatgcaaaaaaaaaaa

SEQ ID NO: 7485 - DNA, 973 bp, Trichoderma harzianum
ccacccaccattgagattctatcgcccaccaagcctacaacacacagcacaagtattatcgcccatcatgcctcagcctattcccgcagccagccgtctcaccgacctcttcagcttgaagggcaaggtcgttgtcgtcaccggagcttccgggccccgaggcatgggaattgaagctgcgcgtggttgcgccgagatgggcgccgacctcgccatcacatattcgtctcgcaaggagggtgcagagaaaaacgctgcagaactggagaaagagtacggcgtcaaggtcaaggtgtacaagatcaatgtgagcgagtacaaagacgtcgaaaagttcgtcgatcaagtggtttccgattttggcaagattgatgccttcattgccaacgccggtgcgacagcaaacagcggagttgttgatggcagttctgacgactgggatcatgttatccagatcgatctgagcggcaccgcgtattgcgcaaaggccgtcggcgctcacttcaagaagcagggtcgcggatcctttgtcataacagcttcaatgtctggccatgtcgcaaactaccctcaggaacagacctcatacaacgttgccaaggctggctgcatacatctggcgcgctctctggccaacgaatggcgcgacttcgcccgagtcaacagtatctcgcccggctatattgacaccggcctgtccgactttatcgattccaagacacaagaactatggaggagcatgatcccaatgggacgcaatggcgacgctaaggaactaaagggcgcgtatgtctatctcgtcagcgatgccagttcatatacgaccggagccgatattgtgattgacggaggatacactacccgatagaaaaccaattcttctttcctctgttgttttaaatttcctctgtactataattataaccttgttcgtaccaacagagatgagattctgatcaaaaaaaaaaaaaaa

SEQ ID NO: 7486 - DNA, 1311 bp, Trichoderma harzianum
ctgaaagcttccatatcgcattctcatggcgactgttgggaatgcggcccggcagatacgagatcgggcactgcgcgaaagatcgatccgcgtgctcgtatcgccaacgccaatctccttcgccgagcgtcgctcagttctgcaggtgctggagcaatatggccctgtcgagttcttcaagatgactcccggctactacgccaactttgtttctataacgagagagccctcgaccgccgaaagattgatagctagcagccctctaacatacaagatcacggagcctgtccgcagcgcggtggaagacatttacgttgcagatctaaacgaaccagagagctttagcaccatgcagccgacaataactgggcaacagacgagcggcgcgaactcttggtccgacggcacggaacagggacaggaacaggaacaaggacgagaggcggaactaaagcaaggggagagagagttcaaactggaaatcttccctgcgcccgagtacaatcatagatttgccatggccggttcaccgctgcacggcatctggaacgatggctacgaacaggatcaatccttcgttgcgacgacactaaggcaatcgctgcccaagagcatcgctagcgaggggcttgtgcactggatggtgagcggcatgaagacgcgaggagggcggcggatgaagaggctgcagatcaaggaatggcttcccagctacatgaagaagggctcgactgagtaagactgagtaagtcaacgagacgatgccgcgctattacgagatacgcggagagctgcgacaggtgctacgacaatgaggaggacgatgctggcccttgtcccgcaatgaatgcgacatgactgagacggacggcctgaattttgccggcgacaatggatgcaaggcggtattgcaaattgcaagaggctggtggtcgcacaagatgtcactgcattcaacaagtcgttgtctcaaaggtgacgccaattaatttccaaagccaaggcaggaaaacaaacaaacaccagccaagcgcgattgggcaattgagggttcccaaaaatggaacaagagccgctggaaaaccaacattgaagacagttttgagggatgaaccataacctaattcagaagttgatgatgatggatctgcgcacgctttgcaactttccttgttctggctccgtcccgacacagcaatacaagaaagcgcgggctggtgctacaactacagctacagctactgtaggtacttcatcatcatgtgcgcataaacatgtgtaatctagaacgtacgagtaaaaaaaaaaaaa

SEQ ID NO: 7487 - DNA, 1413 bp, Trichoderma harzianum
cccacacacatcaagatggcctcttccgcccgtcagtttgcccgcgtggcaacccgcacaaccacccgctccttcgctgccgtcccccgacaggctttccgccagcagggtcgccgcttctactcttctgagcccgagaagaagtcatcctcctctctcctgtaccttggtgctgccgccgccgccggtggtctcggtatctggttcttcacctctggtgcctctgcctcttccaagacctttgtccccacccaggccgattaccagaaggtctacaacgacatcgccgagcgtctcgatgccgattatgatgatggcagctacggccccgtcctggtccgtcttgcatggcactgcagcggtacctacgacaaggagaccaagactggtggcagtaacggtgctaccatgcgattcgctcccgagagcggccacggtgccaacgccggtctgattgctgctcgtgacttcctcgagcctatcaaggccaagtatccctggatctcctactctgatctctggatcctcggtggtgtttgcgccatccaggagatgcacggtcccattgtcccttaccgacctggccgccgtgatggtgacgctgctgcttgcacccccgatggccgtctccccgacgccagccagggcgccaagcacctgcgtgacatcttctaccgcatgggcttcaacgatcaggagattgtcgccctcagcggtggccacgccattggccgatgccactccaaccgatccggttacgagggcccttggaccttctctcccaccatgctgaccaacgacttctacaagctcctgttggaggagaagtggcagtacaagaagtgggacggccccaagcagctcgaggacaagaccaccaagactctgatgatgctgcccaccgaccacgtcctgaccaccgacaaggccttcaggccttgggttgagaagtacgctgccgacaacgacctgttctttaaggacttctccgccgtcgttctccgcctgttcgagctcggtgttccctttgctgagggcagcgagaacagtcgatggaccttcaagcccacccacgcttaaactcccaaattcacatatatgatgaatcaggtgatgtaggacggtgcatataagaagactagcgttgtcaataaggaaattgatagacttgtgaatattttagacatgtaaggccctcttacggtatgaagccgttgagccggctagggttcgaaaaaaaaaaagatgactggacgacaagttcggaagcttgggatggattttatcgcgctttcttcgcaaactgctttttgagggttggtttgtctgggttttcttttgtaatgttctatacctcagccaacaccccgtactctaacaaagaagatgagctttccaaaaaaaaaaaaaaaa

SEQ ID NO: 7488 - DNA, 1387 bp, Trichoderma harzianum
cccacgcgtccgcccacgcgtccgtcacagccttgccttggcaaatagacaacagaaaccctgtttcaagcccgttgactctgtgaagccagatctggatttggcttccatgcgtgcgtcttatactttcaggagaacgccgcagtagactacttaaagacttactctccccacgtcaagacgttcctcttcatccatcttttccaagcacgacaccatgactacccgctcccttcctagcaatggcagctctgcctttgactacatcatcgttggtggaggcaccgcaggctgtgtgattgcctcgagactctccagctatctgcccgagctccgcgttcttctcatcgaggctggtccctccgactttaacctcaaccacgtcctcaatctgagagaatggctgagcctgctgggcggcgagctagactacgactacggcacgacagagcagcccatgggtaacagccatatccgccattctcgtgccaaggttcttggaggatgctcgtcacacaacacgctcatttccttccgtcctttccgccacgacatggaccgctgggttgctcagggctgcaaaggctggacctttgagaatgtcactcgtcacattgacaaccttcgcaacacattccagcctgtccacgcccgtcaccgcaaccagctgtgcaaggattgggtccaggcctgtgccgatgctctcgatattcctgtcattgacgacttcaacaccgagatccgtgaaaagggtcagctcacacagggcgcaggcttcttcaacgtctcgtacaacccagacaacggtcgccgaagcagcgcctctgtcgcttatatccaccccatcctgcgtggtgaggagcggcgaccaaacctgactatcttgaccgaggctcacgtttccaagatcctggtggagaatgatgttgccagtggtatcgttctgcacttggcatcaggtgagaaaacggtgctgaagccccgcaaggagattgttctttgcgctggtgctgttgacactcctcgcctgatgcttcactcaggccttggacctcgctcacagctcgagggtctgggactccccgttgtaaaggatattcccggtgttggcgagaacctgcttgatcaccctgaaaccatcatcatgtgggagctcaagacgccagttcctgccaaccagaccaccatggattcggatgccggtgtctttatccgccgagaacccaccaatgctgctggcaaggacggagatgccgccgacatcatgatgcactgctaccagattcccttcacactcaacacggagcggctgggctatccaaagattcgcgacggctatgcattctgcatgactcccaacattcctcggcctcgatcccgcggccgc

SEQ ID NO: 7489 - DNA, 1205 bp, Trichoderma harzianum
gcgctccgccgtgcccgcagtctccatgcgcaagcggcccagcgacaagaccaccgatggagtcgttcccgccaagcgccagcgcacagattgggtttcccacaaggacctggcccgtttaaagaaggttgccgatggacatcacgagaataccgttgccgtcaaagacgccacgtttgacctatgggatgcccctgcgccggtgacccaagatcctacagatttcctgcctgaaaagattgaggccaaggttccaaagtccatgaagctgaagcccctctctcttctcgccaacggcaaacaagctcccgcagtgccaaagcccacgggaggatacagttacaacccttctttcccagagtacgagagtcgactcgccgaagagagcaccaaggctcttgaagccgagcagaagcgtctcgaagctgaagccgccgaggccgcgaaattagaggccgcagcaaagtctgccgcggaagcagatgccgctgaagaacgagccaacatgtcggagtgggaggaagattctgagtgggagggcttccaatccggcgtagaggacgagaggcccagcgcaaaacagcccaagcgcaagacgcaagcccagcggaaccgcatcaagcgcagaaaggaggaagagcagctcgcacagcacaaggccaacatgaaagcccgccgcgcgcaggagcagcgcatcaaggaaatcgcggcggaagtcgcagaaaaggagaaggaaaaggccctcgagctggccaaggccgccgagcaagactcggatgccgacagcgagattggcgaggaaaagctgcggagaaggcagctgggcaagtacaagctcccggagaaggatctggagcttgttttgccggatgagctgcaggaatcgctgcgactgctcaagcccgagggaaacctgctcaaagaccgatacagaagcttgctgcttagaggaaaggtggagagccgaagacatattccattcaagaagcaggccaagaccaaggttacggaaaagtggacgcacaaagactttgttctgtagacggacggatgatgaatttttcctttttcttttctttttccttcattccttcgttcgcatatccctttgaattttgtttccttaaataaacagacattagatcatggcgtcgtaatattttcttcaataaaaacggctaggaatgaaaaaaaaaaaaaaaaaa

SEQ ID NO: 7490 - DNA, 850 bp, Trichoderma harzianum
acaacatcaacgaaacggtcctagacacagctcacagggtgtttcacaatgccgattgcacctataatcacattcaaggccggccagtgtgacgtcgacacatcgtcgaagccatacaaggtcacgccacagcctgaacctggttatatctatctatactccgaagatgatctggtgcatttctgctggcgacgacgggaccagcctctggatgaccccgaactcgacctcgtcatggttcccacagacggtagcttcctcccatacgaatacaagaccacccctcagcccacagcgaagaccaacggccgcatattcgccctgaaatttgcctcttcctctcagcgccacctcttctggatgcagtctaagccccagggacgaagtggcgacgcgagctacttcagcccccgggatcgcaagatcggcgacattgttcacagactcttgcagggcgaagaggttaacgtgacacgggagctggccgctgttcgaaacaataacgatcaccaagacgacgaagatgaagctatggaggacatcgagggccacggccaccaggatcaccacgcgggaggcagcggcggtgctggccccgatgcgacgggaggcgatataagagaggagggcgagggctcgagagaaggcggagctgatggagcaagagcgtaggtaacccccccttattcttcaaggctggtctcgacacggcccgcgcaaggttgtctggttccaatcactggtctccgagggtcaagaacatgttttttggcatcaaaatgaaggccaattaatgtactaagaaacttccttgtacctttgaacagagctacgccaaaaaaaaaaaaaa

SEQ ID NO: 7491 - DNA, 969 bp, Trichoderma harzianum
cccacgcgtccgccacgcgtccgcccacgcgtccgcccacgcgtccgcgctcgctaagcacctgcaaaacttaccttgacacttttgtcaatttcattctttaagaacaaccgcatcaataatcttaatcaagctccctcgagtttaattcctaataccgacaaaatgaagttcaccgctgctgtcgctctcgccgccgttggcgtttctgccgtctacgttcctcctagcaacgtcaccgttgttaccgatgtcgttgaccaatacgtcacctactgcccctacgctacccagatcacccacggcagcaagacctacaccgtcactgagcccaccactctgaccatcaccgactgcccctgcaccatcacccgccccgttaccgtcaccagcagcgttgtctgcaacacctgcggtaacgccgcccctactggtgctccctccggtggcaacggcggtggttacactcctcctgccttcaccaactccaccatcaccacccctacccaggcccctccccccagcggccctgccagcactggtggtgttgttcctactgctcctcccgccgtccccactggcggtgccagcaaggccgtcctctccggcgccggccttgccggtatcgtcggtctggccgccttcgtcctgtaaatcttgtaaatttcgacacctcgccaatttaccggctacgatttcttggttctacgattcttggaagtcgtcggttcggcctccgttcatgattttgatataaggggggaaaaacacaaagtgttggggtttattattggtttacgttgacgggataccttaagggagtggattattttttgggatgtatagagaagggttctcttgggttaacgggacatgcaagctcggtgtttcaagggaactcgatttttttgatcgcccacggaaagatgcgctacaatatcaaactgtgtgcggtcgaaaaaaaaaaaa

SEQ ID NO: 7492 - DNA, 1244 bp, Trichoderma harzianum
caaaacatcacagtgcacatcatggcgcgagtacttcgcaatagagcggttgcgtcaccgaaaaccaccgacgccgtaaagcctgacagcaccccaaagggcaagagaaaggccgccgaagagtcttctcccgttgtgctgaagaagcagaaatccgccaagaaggaagatgtcgagaccaaggcagccaagtcacccaaggcagccaagtcaccaaagactaagaaggaggaaaagaagaaagaagaagaaaagaagcaagatgtgattgacatggaggaagattccgagtctgagggacaagaagatgagggaaatcttcaggctttggccgtcaacattgacccggaagaagaggcccccgtgaacgacgaagaattccagcccggtcaggacgttggcaagatccccaaggtctcgaaagacgtccagaagtcgatcaaggcatcgaaggaagaacctggcgtcgtttacattggccgaataccccatggtttctacgaatacgaaatgaggcagtacctgtctcaattcggccccatctcccggctgcgtctatcacgcaacaagaagactggcgccagcaagcactttgcctttgtcgaatttaacgaagccagcactgccgagattgtctcaaagaccatggacaactatttgttgtttggacacattttgaaatgcaaggttctctccaaggaccaggtacacgacgacttgttcaagggagcgaacagaagattcaagaaggtgccgtggaataagatggctggtatccagttggaaaagcctctgaccgagtcggcctgggaagccaaggttgccaaggagcgaggtaaccgggcgaagaaggctgccaagctcaaggagctgggttacgagtttgaggctccagagctcaagaaggtccctgcacctattgccgcagcgattgagaatggagaggaggtcaaggcgattgaggctgctccagaggtagccccggaggaagaaaagccggctgaagagacggaggctgctgattcaacagaaaacgccccggcgaagacaaaatcggctgccactcccaagaaggccgccaaggccaaggccaccaagtcgacgacgacaaggacgaggaagaccaaggcttgagtccaatgattggtgattgttatacatatatttgatttcacactcggcaggttcattacggcgcagtggtttaataaaatacaagtgcacttcaaaaaaaaaaaaaaaaa

SEQ ID NO: 7493 - DNA, 1441 bp, Trichoderma harzianum
cgctacggcttatttactcttctgaccggaggtctcggtattgacatgaccttggagccatcgctgccgcaacgaaatggagtactcgtacatgtagccgcagtctcttgtccatgcgagcgggcatttcgtcggcgtcccaatggtcaccgcgagacctatcatttgagatactgtctatcttcctgcatgttggctgtacgagacgaacgatatgacggctccctgcctttgatttctatgcagcagtagccaaaagagaaaaggtgtaatatgcagcaaggccgctatgttgccaccccacgagacctcgactgcatgcacgtccagcgatacgtctccacgaggccgcgcatgaccgctgtgtcgagagtggatggactgcggacacctctctgcttgcaacggctcagcaaattttgccgttgggccaccgaagccaaacggctcaccgtctacgcaattggcactctaaatgctcctttccgcagccgccttgctttcaatacgcgtccacaagcgtttgtagcccttgtcaggccgttgcggttgcccgcgtaccaccgcccagtggagaacaagcgttctcttgtcatttttcttgtgccttggaggtcccacagtctgccgccaaccctgttcgcgtctgttgcggtttgttttgcgccactccgtgagacgtaacaaatcagaggcctggcctaaccaagtgcatgagaagaacctggcaaggtctcagtcttgtggaacgtgagcggcacggcgatagcatttggcgccccttgtcgcgctaccggcgtcagaatggggagacgctgcacggagcgcatggaggtttgtggagatgaagcatccgatagtgacgggggacggagtactccggatgcacaagagctcgctcactacgcgaggcctagacggttctccacagcatcccgactctgcagagaaccagcggtgaacagatgatcgaacgatctattcttggagagagagcactgactatgataccaagcaagctacgccatggagcggagtagcagcaatgagttctccatgcatctcaaatctcgtcaatggcaaggaaagcggaaacgcggaggagcaccttcatgagccgggaaggggtctcgccgtttgttgccattgtctcatcagcttcttattccctggccttatgcactagcccaagcatatacggttgcagtgcagtgtggctggaactttggcaggctgaattccctgttccaaggatgaaggaaaagccaacaaagtacgaggactaatccgtatcttcttgtgcatcatgtagcgcccaactacctacccatcaaggcttcccctgcagttggctcctcttgttctgtgccagtcaaaaatagtacctactcagcttgaatcgaagactcgatgaggagcttctgctgcaaaaaaaaaaaaa

SEQ ID NO: 7494 - DNA, 1599 bp, Trichoderma harzianum
cccacgcgtccgcccacgcgtccgagaccagccatcaatcacaactccgtactcgctgcagacagacactcttgcaccttgagcaagttcaattggcgctgagagggcgaaagagtgcaaaagttatcttgctgccaccagttatctgcctgcaacccgcaaagtggcccaaaccaaaggctcagcccaacgctgatcacggctttcgtattcggcagcgatggacaggcaccacaatcgcactccctttcatctgcttcttctctcgagcttctttttttcctttgctcgcctcacatttcttctagtggatgacgcaactggccgcggggatcgtcgacgccaatctatctctctcattctctctctctctttttctgagggttaatttcgtatctacctacttacagccacagtcacagctcgacaagtattggcagtattgcctactagtattcccaccgctcgcttaggcggccaaggcattccctgtcgaatgacacgaatctcatcttacagtagacagacccggaaaagcggggatggacatgacatgtgtgtgtgcttcatggcggcctgagagcctggccatgcgtgaaatgccatgccgtgcgtcaacaagcgtcgagcagcgctggctggctggtgatacgccatggcctcgttcgttctctggtctggggaacccgggaggggagaagacggaagaggagagaggagagagggaacaaacagagacgagaggccagccagccttatcgagcaccgtccgtctgcctcttctgcctcttctgcctcattctcgatgcccagcaccgtggcatcgcacagcaccgcacagcacgcaacaacagcaaccacatcaccagaacatcatgcaccttgtgctcccgtccttccagaacctctccaattcgctccccccctgcaacctccctcgcgcgaactgcaaatcgccatgccattgatggcacaagtgcaagcaagcatcatgtactctgacactctgtgcatgtctaccgcatactcgtacctcgcggccaagtactcgatacctttgctgagcttcgaggctagggccgcatcgcatcgcggctccaccttgtactgtacattacatgtgtacattacatgtgcacattacatggcttgtccagatccagcgtctgggacctctttgaagacctgggtgacttgtgaacattgtacctgtggaggatgccatgttttggcatttaatgtggccactgttgcagtggaatataatccgattcgctctagtgttttcgacgacagaagctctcgttactgctcatggagaaactcgcgatggagtcggacctttgtaccactcaccggcagctttgcttgataacctgcagaacagaggcgtgctgagatgatctcgctccccaacctccgctttattgccagagacgagctgcgtacagtgtaaatgtgtatgcgatatctactcaggggtgggcggtgtgtgccattgcatttcatctctttttaacaccacttcaggcttactattgatcatctcgtacatacaatcacctgtaggctgttggatacctaaaaaaaaaaaaaaaa

SEQ ID NO: 7495 - DNA, 887 bp, Trichoderma harzianum
cgaacagccctcaccgtcggaggagaagggccactggccgcgcagatacctttcgtcgcgagaatcgtcagacagctctggcgagattgagcaattttctatttctcgagagtcgtttgactcgtaccgacgctcatttgatatctcggcacgatcccccatttctgcgtacgacgttcccgctcgcatgagtctcgactcagctcgattcgctcgaatgcctaggtcggcaatcaaccgtaacatagagcaactgcccaccgctgaggagaactttgaggacgtcggactcgaggaccagaagcagccgccccgcaaacgaggtttcttttccaaactgacagagacccaagagaaggactccactgctcagacaggagtctcgagattcctcatgcccggtcggaagagggctcaaagcggccaaggggccgagttagcggcaatggaccagccgacggtgacttcatcaaactgagaaatgcctgccacgggaagcaacgacgacaacgactctgcaacttgaaataatttatcgtacataccttttcaaaagtgtatcaggcgcccatgtttttttttctggactatggatatgttttatttctgcaacgacggcgtttgggacggcgtaaacggtggacgcacatttgccgccgtcacatcttgcaaggacaactgtataatggggagtttgtatttcgcatccaacgatgcttgctggtacgcccacgattcaagggctggcagacttggagagtttataaaggcgagggactattcaagcaaggaaaagcaagacgacttaatgataatcacttatgtcggcgatcacatacttgatcgctaatacagcacatcttacgtttgaacaaaaaaaaaaaaaa

SEQ ID NO: 7496 - DNA, 665 bp, Trichoderma harzianum
ccccactgtcgctatcatggcccgcggaaatcagcgtgatttggcgcgcgcaaaaaatcagaagaatgcgtccaaacatgtgagtcggttttgcatataaaatcctcaacaggaaccagggttgactaattcggtgtcgtgtctttgcagaaaggcggcaataccgagaacggatatgagcaagcaaaatccaagttgagtaacgccgagattatgaggcagaagcaagccaaaggtccgaacaaccaagtctacccaatacctcttacgaaccagtcaacttaccaaggcaacagccaatgccgagagagacctagcggcagcaaaggcattacaagagaaaagggacgcaaaggcgaagaaaccgactgaattgggcgcttcagctgtggaggttactggacatgcaaataacccaagaggatagcaagagatgggagaaaacacggcacggcgaaatcaggcgctccttgagactttcacaatacggcgcaaatttgggacaatctaggtgaagagggggaagcgttttttggcttaataccaggtatagccatggataatagcgaaatggatattttgttgcggtattgctattattattctaccaaaaaaagttcgacctttgtgtccctttttttcccctcgaaaaaaaaaaaaaaaaa

SEQ ID NO: 7497 - DNA, 1368 bp, Trichoderma harzianum
catcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttgacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaaaggccggtctcggcgtcagcgtcgtctacggaacgcttcccaagcccgccatcttgaagatgcgcgaaaatcacaagaacctcgaccccgacgtcgagtcgctggaattcttcgctgctggcctgagcatggtgctccatccgtacaaccccatggctcccaccgtgcacctgaattaccgatacttcgaaacggccaatcccgacggtacctctcaggcgtggtggtttggaggcggttgcgacttgacgccctcatacctctttgacgaagacgccatccacttccacaagaccatcaaggctgcctgcgacaatcacgacaagacatactaccctcgattcaagaaatggtgcgacaagtacttttacaacaagcatcgtggtgagtgccgaggcgtgggtggtatcttctttgacgatctagacgagtccgaacgagaccaggagaacacttttgcattcatccaggactgcctgaagtccttcctgccgtcctacgtccccattctcgagaagcgaaaggacatgccttacgatgacaaggaaaagatgtggcagcaaatccgtagaggcaagtatgtcgagttcaacctggttcacgaccgaggcaccgcctttggactgaacacgcctggatcacgagtcgagagtattctcatgagcttgccattgacggcaagctggaagtacatgtatgagccagagcccaagagcagggagcagagactggtggacgtcttgaaggagcccaaggagtgggtttgatttggtatatttccgtgtaataatgcataaaacagtatattttgtagtgtagcggcatagattaaaaaagacaatagcatcatgagttccaaaaaaaaaaaaaaa

SEQ ID NO: 7498 - DNA, 1077 bp, Trichoderma harzianum
gcagcctaaaagcaaaccgtctcatcttacatggccttgttcctttccatactccattcttccccaaccccaacaccccgccagccgttctgtcagcgccacagcgcattagcctcatcacctcattgctcactggtctgcaaacattgcgcaaggcggtgaatttttcatgtcgagaattgacattatataacagcacgtattctaagattcatgtattaagtgccgaggaaattcatttcttccccatccgtcaaagtcctaggtaagtaacaatgcattaatcgtaatgtccaactcggagagttttcaatactccttatcgataagtcattatgtaatcaatcctgccgggaagggaaattttgctcctctcccaaacctcaaatcgcatctccaaagccctgtgacgacatacaacacccgaacagcaatatcaaacccccaaacaccaaggaacaagccctcaccccgtattttacctcccagtttacaaaaacaaaacacaagaataaaacaacaaccatgtctttcctcggaatcggtcgtccccagcccacctcggagcaaaagattgctgccgtcgagggcgagatgcgcatgatggctgatacctacaaccgcctgcaaaagacttgccagaaaaagtgcgtccccaccgactaccgcgagggcgagctcaacaagggcgagtccgtctgcctcgaccgctgcaccgcaaagttcctcgacacgtccatgaagattagcgaaatcatgcagcagcagggccaggccatgggcgccggaggacctcagggcggactgttctaaaaagggaacagtcccccagtgtaaagctatagaataccgaagattaaagaaaagagaaaacaagagggaggcaattgatatcgaacaatgtcttcttcctggccgtgaaacatggaacgtcatgggaatttttgtacgattatatggggagttagttgtctgcgttcaaagggagggctttgatgatatgatgggatcatgggatatacatatgtcatgtcaaagatgtataaagctatcaaagactataccaaaaaaaaaaaa

SEQ ID NO: 7499 - DNA, 381 bp, Trichoderma harzianum
ctggcgtggcgcctcagccagaagcgttgctgatgacacccgacctcgcatttgtgtactagtatgtacacaacacagccgtgtgtcagagtatcatatcagagctaaggttaggtagacagacagacggcttcgtttggcaactcgctggatgccagatggcagagcttagatggtcagcttggatggttgagcacagatgtgaataggcacctgcgaggaccagcagtgagcaatattggagcagtaagagtaaggtagctgtcgggatagagacttgaggacgggctgctccgtccggtccccatctcgtggaacccgtaatccagtcaatggataccataatcaatccataactcctccataaaaaaaaaaaaaaaa

SEQ ID NO: 7500 - DNA, 1150 bp, Trichoderma harzianum
aagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaaccctcaataccaatcttaccttttgcggcgcgtgctagaaagaatgttgaaaattcaagattgaccctcgatgctgtcaaagctcgtggtaaagggaacgacctttaaacttggcggcggccacgctcgagctgatcgtcccgacgaagcagagctcagcgctgacgctcaagaagaaatcgagaaagcagaggacgagttcgtgacccagaccgaggaagcggttggtgtgatgaagaacgttttggacacccctgaaccacttcgtaacctcgccgaacttgttgctgcccaaatggaatatcacaagaaggcatacgagattctaagtgaactcgctccggtcctcgagaccctgcagacggagcaagaagccagctaccgaagaaatcgtgatatggcttgaggaatatctaatgctttagttgcgtgatgcaagtaggattttcaacattagttgatgaatgccgcataatatataccttgcttgttagttctgaagcttgaacacgacccaattatgaataaaaagatgcaataaaaaaaaaaa

SEQ ID NO: 7501 - DNA, 797 bp, Trichoderma harzianum
ctgcccacaatgtcgctttctgttggtgcttctctgcggcctgcggccttccgctgcgttggtgcgtctgccgtgcgcatgcgatgtgcttttggcacaactgcgtccagaaggagtgagagctcgacgccgggcgagcttggggttggagagctgcagggcgcatcgtttcgcattgagcctctccggagggttggggaggatgcttcgactatgcgagcgagacttttataccaatctcggaagcgcggaaccctcgagtcggatcttttactgtctacgtttgcctcacagaacctgcccaccatgacggccgaagaactgcggcagtacgacctcttcctcgacgagaacgactgggacatatactactgggcgacgcagcgggagccgaattccacgacgaacccttccgtgacggcgagtccggcgagtgcttcggcgagcgaagggttcgaggcgagacagcaggatgagttgcccaagaatccgccaaagggggagtgggcgcagacggtgggcaattttaagcctgcgtataggccggtgccgcagaggtggaaggatagcgagattttggagaagttgagggcgcatgtgaggaggaagagtgtgaatgggggggaggggacggggatggcgtttatgccgcctttggagtcgtgattttgacgatggagaaggtgaaaagagatgaagtaaggaacggtaaaaggattttgggtgggaatgttacgatagggtttacgagatgtgtataacaggcaggattaagtgacgacgcaaaaaaaaaaaaa

SEQ ID NO: 7502 - DNA, 845 bp, Trichoderma harzianum
cttctcatcacattccaaccatcttcatccatcgtctttgattcatcaaacagctcttggatccgttctgatccagccaaccaaccatcgccatgtctgaacctctcaccaaggtcgactccgccgttcaaggcctgtcatcatcaccgcccaaagagaagggccataggagaacaagctctagcgcggctggtgttatgaccattgcggaaatcaatgaaagccatgctcctctagaactcgcaatagagacacagcagacagcgtggaaaataaatcagcggcccaaggatctcgacaatgatcagctgctacaggttcccctcaccaagcctcccatcaagagcataacattgaggttccctcatggcaaagaagtcgtggctcgcaacctgaagggcctgacaataggtgacgccctgtcggccattcacaaggcaaacaagaaccgagctgatgatgagcttgataatccatacctcaagggcttcgcatgggatcagggcgagaactactttgaagtacatctccagagccagccggcgacgggctcgtcaagcggcggtggcggtggcaagaagaagaagaagtccaaggacaatgacgagtaaatgaatatccacccatcctaatgtctgttcaatagttccttcaattgtttttttgtttggcttcgcctggttcgtgcgagtcggcgcccgggatattgcaactagatgttgttggtcgggatatgatgacgcgattgctggatgcatcgcttatgtactcaatttactttcacggaaacggagtgttttacgctcttaatgtataacttgaaattctgaaaaaaaaaaaaaaaa

SEQ ID NO: 7503 - DNA, 893 bp, Trichoderma harzianum
aaacaagcttctccatcttttttcagactccttgagaagagaactcggacttagacttgacttaactgtctattacacacacagctctccactaaaagcatcgagctcttacacaacaacacacaaacaactttgtcaacactcacaaacccttatccggtttcactcaactcttttctctctcaacaacaaactcactcacaatcactatgccttcttctcaaggacaaagctggtgggcccgccactgcaccccccgacccccgatcaacaaggtcgtcgcctgcccctgccactactgctacaacaagcccgcctgcgagctcgactaccccgagtcgtccaactgctccgagacgaacacccctgctcagtcgaggcctgtcagcccccgaggccgcaccagctcgtcttcgtcttttcacgttgagaaggccgagaagcagtaaacgacacattcgatcatcgaaatcattcaaatcacaaaagcgagtacatctttgaagatcctttggatactataggatatacacacactttcggtttcaacattttcctttgtttcattctctctctactgagcgagcgaatacaaatataaaacgggcgcgaaaaaaaagcaccaacggcgcttctcccgatcagttcgggttcggcgtccggccccacttggagcggccaggccggacaaaatacacacacacacacaataaggaaggggaaaaggattttggcaaaggagggaggaatacataatacgagcggatattgggtcttagcgatggaatttttgttggaataccccccttgatggaattttagagccttttcatatgtttatgtttatttttacttaaatcaataccttatttacaaataaaaaaaaaaaaaaa

SEQ ID NO: 7504 - DNA, 921 bp, Trichoderma harzianum
agaaccacagaattcatgggccgccgctatgcagatgggcacatcgagcagatcatggggcttcatttagcgaagcgaagcatcctcgaggcttggattcgtccaagccaaactagcgcagatagcaggtatcacgataccttgtctctcatttactcatgacgaattatcttgttgagaaaaaagaaaagaaaagagtcggcaacgcgcgttttggcgagcatggcttgtcgggatcttttgtcgaatctcggcggacggttgatacccagcatcaagggggtttgggcgcgcatagcgacgattttggttctgtgccgtttgccatctcatatcgagcctggagttttggacggctgatatttttcaccctcgtggaattttcctttgtcgtctagttcacgctgacaagttgttttttccttggtttattttgtctccttgcgcgcaagttgttgcacctcgagccggcgttttggaggcttcttagctggatgcgcgtgcatccgtgtataatagtatgaatgagtcgttgttttttgttgtatttttgcgttttttttttttttttttcgggtttcggagacgcaaggggaggacacgatgttgagggtctggcatggctgagacaaaaacccccagacttttgaaaagggcaaacgttggagttgttggaacttgagcagaaaaatacgttatcgagcatttcctgcactatatctgggaaggcggcaggctggagtttggatggcagggacggacgaggcaattgtcatgcagatggtagaccagatcgtccttctgggaaggcacgatagtaacctgatttctcatcgcaccttcttttctacttgacttgccgttagtattaaaatcttggtaatgaataaagacatgatgacaaaaaaaaaaaaaaaaaaa

SEQ ID NO: 7505 - DNA, 1648 bp, Trichoderma harzianum
gcttctccaagacgaaaatggaagactacagcaacgaccccaaacatgacctcaccccagaggctgccgccctggcacaactgggtcacaagcaggaactcaagcgaaatttctccctgatttctatgctgggtcttgcctttgccatcctcaacacatggacggccttggcagcttcaattacactcgctctcccctctggcggcgctagttccgttatctggggtctgatcgtggccggtatctgcaatctgtgccaggctgcttctctcgccgagttcctttccgcctaccccacagccggaggtcagtatcactgggccgccattgtttcatggaagcgatggagccgcggtattagctatgttactgggtggatcaatgtatccggctgggttgctcttagtgccaccggtggtttgcttggcagcacattcatcgtgaacatcatttcgctgcttcaccccgactatgagcctaaggcttggcatcaattcctgatttacatcggcttcgctctcattgccttggtcatcaatgctttcatgaccagaattctgcctctcttcaccaaggccgcgttcttctggtcggttgccggcttcgtcatcatcagcattacggtcttggccaccgcgtccccggattaccagtctggcgagtttgtctacggcaacttcatcaatgaggttggctggcccgatggtatggcttggctgctcggattgctgcagggagcatttgccctgacaggtttcgatgcggttgcccacatgattgaggaaattccagagccacataaggagggccccaagatcatgctttactgcatcggcattggcatgttcactggattcatcttcctcaccgcgctgctcttctgcatcaaggacgtcgacgacgtcatcagtgctgcttacggtccgctgctgcagatcttcatggacgcaaccaacagcaaggctggcagtgtgtgcctcctcatgttccccctcgtctgcatgcttttcaccaccgtcaccctggtcgccaccagcacccgaatgagctacgctttcgctcgtgacaagggaatgcccttcagcagtgtcttcgctcaggtgcaccccactctcgacgtccctatcaacgctctgctctggactgtggcttgggtcatcatctttggctgcatcttcctgggctctagcagcaccttcaacgccattacatcggcatccgttgtggctcttggtgtcacctatgccattcctccggcgatcaacgtcctccgcggccgaaagatgcttccggagaatcgctccttcaggattcccgagcctttcggctggattatgaacattgttggaatcctttgggctatcttgaccaccgtcttgttcgtgttccctccggaacttcccgtcacccccgccaacatgaactactgcattgtcgcctttggcgtcattctcctcatttcgggcggtacttggattttcggcggccgaaagacgtacacgggacctgtcgtggacatccagggcatgttccacggcactgttgacggcttggatggcctggaaggcctggacgctgcgcagtcggacagcgttcgtgaggatcacgctgcggaaaagaaataaatttccttgtcgtagatctagcg

SEQ ID NO: 7506 - DNA, 1294 bp, Poppy
gttcttgtcattaattaagtcgacgaattcgcagagaaaaaagagagaaacatgtggagatcatttggaaatggtgggttgggaggaggcgcaagtggtagtggtggcatgttaagagcagtaaggattagggcaactgttggtggaggattgcaagatcctgtaaccataaaaaaacctaactcaacaaaacccacaacaccaaactcttacaatactaatgtgttaaccctatcaacacatactcgcggtggttcatcagttaataataatcaagttttattatcatcaccaacatcatcagcttcagtttctaatgcttcttcgtctagatattcatcatcttgttcatatttatatgattctactgatgaatgggagtgggaaactgttgacaaagatggtgaggaaaacaaagatgatttggttttatcaaatggatattatgatatctttggcgctgttccttctatggatgaagttagagatgcggtttctaatcttcaacaattttcttcggctgcatcagacgaggattgggtcgaacctgctttacaggttaataatccaagaacattgaggtctcatggatatgaaagggtttatactgctttccatttattgcagacagatccaagtgttcagagaatggtagtttctttatctaccgataaagctctatgggatgctgttttaaataatgaagctgttcaggagcttagagagtcctttcgctcagctgaaagtggcgaggagctgtgcagttctgaggaaggcttgcctctggatgaacctaagaacatgttgaagtggatgttggaggaaacaaaagggaaatttatagaatttgttgaaaaaataacatcacttttaagtgccatgtttcaacctcaagagaaggaaccagaagtagccaatgatatgtttgaagatactctgaggtcatctttattcctctcggtcatggtcctcatggttgtggtcatcactcgtgctcaaaggacttgatcgatcattcgttgacattgcagtggaataagttccaataattaggtgaaattacagtagaaagtagattttgtaattagaacaaaaggctacaaatactcctgcacagttggggtttgaaaaaaacaatcttttgtgcatagtttttagtttttagtttttaccgacaggtaacctctgttttgataactcatcatgttggatggtgacctgaagtcatgtttggatgactagtacaatttcgatatgtttatttactcttgcttgttcccaaaaaaaaaaaaaa

SEQ ID NO: 7507 - DNA, 494 bp, Trichoderma harzianum
tgaaagagaaggactttatcacacaagccgtttcggtttctacttctccttattgttattattacatctcggtgcaccgctgcatatgggcatggaatggaggctttttctttttcttcttttcttcttgttggtcagtcttttacgaaatacgcaacaagaccttgggtggagttctatggatacgaatatgaggcgtttgcagtggatacgtgaatgtggaacgagaaacgtacgcaagacgagtatgagtctcttgcatgaaatagcatgatgggtggtttggagaaggactaagcaagtggttgctgtcctgagcctttggccgtctgcgacttggggttgttggaacaggccttgcatgtctttatgactgacagaggtgagcttggagttagcgcttttgaaggcagctcttttcaacaagttgcaaatttccattttatcattctataagctgttccatctccttatttccactaaaaaaaaaaaaa

SEQ ID NO: 7508 - DNA, 751 bp, Trichoderma harzianum
cctcgcatcgcgccgttccgcgctaaaacgccccctccgttgccttcttctattttctactggaacggaggagtccgtcctggttcctggactggactggacttggaacaagcagatgcagttagagagggggggaagagtgaaaatgccattgccagggaagaagctgtttggcgaggagggggaaaagctgctgggctgggcgggaatgtcgtcatggctccattctaggcctgtcgcttccaagcagcccactaaatccaacccagtaggtcagtttatgcacagaatagctgcatgtctggcaccatcatcaaggcatccccgaaaggaagaaaaaaaaaaggaaaaaatcaccgccaagtgccgcattgactcgtagagtctctttcggccattgccggtatgcctccgaatcagcctgccaacttgactgtgcgctaccggagcttgcgccctaccagtattactgcccgtattccatcttaggttctattcgtagccgccttatattgccctgaaaggtgtcattcagcctaccggaaagccgacggatgagcccaatggcgcttactagtatgccagagactgccgtcccttacaatgaaagccgaaaaagcctcctagaagccggcgctggctccgaaatgccattctgcagccgttcattggttacaaggtgaagaatcctggatatccgatttctatgtctgtatgtaaggtacaaaaaaaaaaaaaaaaaaaaaaaaaa

SEQ ID NO: 7509 - DNA, 969 bp, Trichoderma harzianum
ccgactacgtacctcccccctacggcgcctatccccaaaccccggtagcgacacccaccggccagcctaaacacgaaccctatttcccgccgccaactcgaccccagcgagcgcaaggcttcgaggctccaaatcaaaacgccgcacctcccgtatcgtacaggcccgacggacggagtttcagaccgtcgctgcctccattatccacgtcgaccgacccctaccaatcttttggaagcgctggccttccatcgtcctcatcctcagatatgccgccacgaaaggtagtggcgcctccgccccctaccccagccgtcgagccgtctcctgtccggacaaaattcccgacggcccggatcaagcggatcatgcaggccgacgaggaggtaggcaaggtcgctcagcaaacgcccattgctgtgggcaaggcattagagctgtttatgatccagctcgtcacaaagagcgcagatgttgccaaggacaagggttccaagagagtgacggcgtccatgttgaagcaggtggtggaggcggacgagcagtgggactttcttagagagattgtcggccgcgtggagaatgagaaggagggtagcaagtccaaggccaaggccgagagcgaaaccgacgaagagatgatggaggagcccaagaagcgaggcagaggtggccgtcgtaagaaggtacaatgacctcgaacatgcacgcttgatgatgggtacgaagattgggatgactggcgttttactggcaaaaaacataccattttgttattttcatacaacggcgttggggacggacacattcgggagggggtggaactctagacggccgtgtagttgtgaggctctctatctagatgcgcacgacaactacgtgaggtgtcttggtgctgtaaccattttgttctcttttattgccacatgtccactattataatagctttcatcctaaaaaaaaaaaaaa

SEQ ID NO: 7510 - DNA, 981 bp, Trichoderma harzianum
cccacgcgtccgagatctctttcgatatctcatccttgcaactcgtctgtctcctgcagcaccgaatatcgtttcctggaaactttaaatctatcaaaacaacaacttccttttacacatccaccatgaagttctctagctttgctgtccttgccgttgccgcccttgttcaggccaacccagctccctctcccgccccatctcctgctcccggcctgggcgacttcatcgacgacgcttccacctggctcactggcaaggccggcgaggtcaagacctggctctccgacaaggctggcgaggcctcctccttcgccagccacgtccagtccaaagtcgacgccaacgagtccaaggccagcgcggcagccagcgccatcaaatccatcttcgacgatgcgccctccagcgtcatcgccagcctgacctccgaagccggctccaagttcagctccctcagcagcgttgccgccactgccaccggtgcagctgcctcctcggtcaacgccgacatttccaagctcagcgcctcccttgccagtgcgaccacgtgaggctgccgctgccgcgtccacaaagtcccacgacgctgctcctgtccagactgcctatattgcaattggagccctgatgggcggagctgctgtcctggccaacatgtaaggtagcgaatgctatcatcggagaatcaagcctgctgaaatggagagaaatgggtggaatatatactagagtgtacttctatctgggaggcatggaaacagaaaacatgagaatggatggataacgaaatacccctaagttcgcgagagcacacatggcacaccttggttgagagagcttttctttttcttttttcctagctgttttgtattatcttggctctttgttgagatgagtctttatgaataacggtctgaggctgcattagttggcgaatctactacactgtcatttcttgattcagaaaaaaaaaaaaaa

SEQ ID NO: 7511 - DNA, 1035 bp, Trichoderma harzianum
cccacgcgtccgcccacgcgtccgctgtcttgcttactctgttactgaactcattgttctttgaattgaaccttacgatatcaattacaacccattgagctgctgcaccaccaagctaccacacttacatacaaacacacacacacacaaatcaccactacaataaccacacaaatcaacaacaccaaaacaacaacaacaaccgtcacaatgcccgtcaactacgtcttcacagagtccgccccctcccaaaacaactacatcagatccggccgcggcggcgctggcaacattgtccgctcctcagccctccctcccacatcatcatcctccgcctcctcctcagcctcccgccagctccccaaccagcgcttcttctctggcatcggcggcgccggcaacgtccaccaggccgacaagctccagcccgctctgctgcactccctcgagacccccgccaaccagaacccatcgcgaggccacgtcggccgcggcggtgcgggcaacgtctacaaccgcaagcctagcgatgccagcagtgtgtcgagcgcgggcagcactgctagctcggttggcgagaaggccaagatgtgggcgtctcgcgtgagcggctcattctcacgaaagtagatgagatgtctacatatccatctccatctatatacctactactggttgaggatataactggacttgaaaatgaaagaaagaaacaaaatataatcaacaaaaactggcgttgaggatacaacacggtactggatgacatttggggagagcgattttgatacacaacaacacaaaaaaatacacacataaacctgtgtgatggatttacgattacgaatatacccgcctggtttataggctatctgggaattgaattgaattggagtttttgggagcagaatcaagcggcacggaatggatgctgctttgagagaatataggcggaaaagttacctgagagatacactagttgataatgctaaatcaatgcaaacacattctactcgctaaaaaaaaaaaaaaaaa

SEQ ID NO: 7512 - DNA, 1847 bp, Trichoderma harzianum
ctcgacccacgcgtccgcagctctgctctgttgtgtctgtatattaagacgtcgttcctgccatctcttcccccttatcctccctcttcttctctttctcgccaccctatacttacccctccttggccttgttcgtacaacaggaccaacaacttgtgaatgctctcatccttttccaaaagactcaagagcaagagattcagaaagtccaaagccatgatccgacccaccttcgtcggagccatagaccagggcaccacaagctctcggttcctcatcttcaaccagaggggcgaggtggttgccacgcatcagttagagtttgcacagcactatcctcatcctggatggcatgagcatgatcctgaagagcttgtttcgtctgtggagacttgcgttgatggtgctgttgttgagtttgagaagcagggtcacaaccgtgagcagattgttgccgtcggtatcaccaatcagcgtgagacaactgtcgtttgggacaagacgacgggcaaggcgctgcacaatgccattgtctggaccgatgctcgatcccaggagctggttcgcaagctgaagcatcgtattggagctagcgagctcatcagccgatgtggtctccctctatcaacgtatccctctgttagcaagctgttgtggctccttgagaatgtaactgaggtcaaggaggcctatgagcgtggaactcttgcgtttggcacagtcgactcttggttgacgtacaagctcaacggtggaacagcccgcaacatccatgtcacagatccttccaacgcctcacggaccatgttcatgaatcttgagtcgctcagctacgacgctgatctcattgattggttccgccttgaccgaagcaaggtcaaccttccaaagattgtgccctcttcagacactgaggcgtacggctctctggcaaccacttcgctcaagggcaccaaaatcaccggatgcttgggcgaccagtcggctgcattggttggccagaagggttttaccgccggccttgccaagaacacttatggcaccgggtgtttcttgctgtacaacgtaggccccaagcctgtcatttcgacccacggtctcctgaccactgttgcctttgattttggtgagggtaagagaatgtatgctctcgagggtagtattgccgtggctggatccagtgtcaaatttttggttgacaactttggcttcatcgagtcgtcatccaagcttagtgctcttgccgaagaggtcgaggacaatggaggctgcactttcgtcactgctttcagcggtctctttgccccttactggatcgacgatgcccgaggaaccatctttggcatcactgcctacacccagcgtggtcacattgctcgcgccacgctcgaggccacatgcttccagacacaagccatccttcgagccatggagaaggacagcggaaagccgctcactgaactcctcgtcgatggtggcatgtgcaactcagatcttattatgcagactcaatctgatttcactggcatcaaggtcaacagaccaggaatgcgagaaaccacggcgctgggtgccgccatcgcggctgggttggcagtgggtgtttggaacagcttcgaggaccttgagaacgtaaacaacgagggtcgcacctttttcaagcctcagatctcagagcaggaggcgagcaagaagtttgctcgatgggagaaggcggttcagatgagcaagggctggttgaacgacgagtaatgaagtactttgcgagaaagaaagcatgtaatgaaatcttgttagtctagcaataattaataccacgagcgattggctgtcaaaaaaaaaaaaaa

SEQ ID NO: 7513 - DNA, 867 bp, Trichoderma harzianum
cccacgcgtccgcgagaccaaggagtggctctctgaggttgctgagcatgcgcaggcgctcaaggtcgatggtggcttcgaggagggtgccgatctgggccccgtcatctccccccagagcaaggagcgcatcttgagcatcattgacagcgccgagaaggagggtgctacgatcctgctcgacggccgtggcttcaagtctgaaaagtaccccaacggcaacttcatcggacccaccatcatctccaacgtcactcccgacatgacctgctacaagcaggagatcttcggccccgtgctggtgtgcctcaacgtcgagaccatcgacgacgccattgagctcatcaacaagaacgagtacggcaacggcgttgccatcttcacaaagtcgggcgccaccgccgagacgttccgcaagaacatcgaggccggccaggtgggcatcaacgtgcccatccccgtgccgctgcccatgttctccttcaccggcaacaagaagtcgattgccggaggcggtgccaacaccttctacggccgacctggtatcaacttttacacgcagctcaagacggtgacggcgttatggcagagcgccgatgccgtggccaaaaaggccgcggtgcacatgcccacgctgcagtagaagatgaaattgggttgagcggtttaggattgtttgtgtgcggaatatgacggaatggtgggaaaaattgatgatgccttgatgaaatgaagggtggttgtctcacagaacatgcatgtactgtacataatatagccacgagcagatgggctggacagcatgggaattgctttttttaagcagaatgaaataaatctacgttaaatccaaaaaaaaaaaaaaaa

SEQ ID NO: 7514 - DNA, 1127 bp, Poppy
gtcgacgaattcatgaccaaaagattttagagacagaggatgggtaacttttggtcataaacctttaaatcagaaaaaatggtgaaaggtccaggactttacactaatctcggaaagacagctagagatcttctttacaaggattatcaaagtgaccagaagtttagtgttactacatactctgaaaacggagtggcgatttgttcatctggaacaaaaaaaggtgaggtattcttagcagacgtgaacacccagctgaaacagaagaacatcacagctgatatcaaagtggacacaaattctaggctctctacgattgttactattgatgaacctgcaccaggtgtcaaggctataattagcttcattgctcccaaattgctgctggaactgatgtgtcctttgacacaacatcggggaattttgtgaagtacaatgctgggttgagcttggctcgccctgacctggttgcttcgttgactttgaatgacaaaggtgacagcttgaacgcctcttactatcagacattgactgacctgagcaacgcatctgctggtgctgaactgagctatagcttttcccgtgcccagagtacacttactattggtgcccaacatgcattggatcagcaaactgcagtgaaggctaagttgaacaatttaggcataatgaatgccttaatccagcatgaaatttaccccaagtcatatttcaccatctccggagaagttgacaccaaagccatcgagaagagcgcaaaatttggtttggctcttgctttgaagccatagatgatcaaaatctcttgaaaatgcaaagggtaggtagtagaacagtgcacagtagtagttgagtatgtttttgaacatgtaaaactacacgtttcctttggttgcattttccatcccatttcattgtttgaagatgaaacactcttttttctagcagtttgtgaggttcattttggaacgttgttctgttccaatttgatgaaaatcttttttatttttgtggagctggaacttatttttataatcagtattttgtaggaagcacctccacattaaaagttctctaacgttttttctttagggtccatgtgttgtttttgctaaaaaaaaaaaaaa

SEQ ID NO: 7515 - DNA, 1288 bp, Trichoderma harzianum
cgtgttttggtgccctcgtccgcttccgctcgctcacctcagatggccgcgccgacccgagctgtggccggtgtggcaagcggcctgtcccggctggtgcctcgttctcgtccacggctgccaattgcctctgtttctattacagcaaagacgacggcatcatcgcgatggcactcgggcttctcgtcggtcaaccccaacgaggtctcacacttcaatgccctcgccgctgagtggtgggagccgcacggatcgtcgcgcctactacacctcatgaacccgctgcgccacgacttcatccgctcctgtcgcgagtcctccgacgacctcaattccatcacatacctcgacattggctgcggcggcggcatcttcgctgagagcgccgcccgcctagccaccaccaagcacgtcaccgccatcgatcccacaccgtccgtcctcaacgtcgcaaaagcacatgcccgcaaagacccttctttggcggggaagctgtcctaccgacagtcttcggtcgagcagctcgaggtccctgccgagggccagggctacgacgtcgtgactctctttgaagttattgagcacattgacgatccgggagcgtttctagaccgcgtgcgcccgctcgtcaagcctggcgggtggctcatcatgagcaccattgcgcggacgtgggtcagctggttgacgacgaacctcattgccgaggacatcttgcgcatcgtgccgccggggacgcacgactggaataaatacatcaacgagggcgagctgagggggtatcttgccggcaagggctgggacagcgcaaaggtaatgggcgttgtctatgtccctgggtttgggtggagggaggtcaagggcagcgaaaaggtgggcaactatttctttgctgtgcgcaaggcatagagaagagagggaaacaaaaaattggtgagaaagtcgccacgggcgaagcatcacaggctacctgcttgtaaaaaaagaacacatgtgtattaatatggctttgggagatttgatacccctttgatgtcttacgaagttcacgatgggacatgggcggtgcaaaagccactgtacgatagttgatggaaccggaaataagctcattgcattagagagaggtctgaaaaaatggtgagaagctttctcgatcatctagctccaaaatttttatttcttgctgggtatcattttgtatagaatcttcatttctaccaactggagcaccataaatcaatctcatttgatggccaccattggggtctttcaaaaaaaaaaaaaa

SEQ ID NO: 7516 - DNA, 1234 bp, Trichoderma harzianum
caagccaaccagcaacaacaaaaccccctcaacttacaacccaacacaatctcttcaattacatcccacttatatactacctttaaagaaaacatccaatcaaaatgaccaaagtcctcatccttggcgctactggttatgtcggcaagagactagctgagactctagttcgaagcggccagcaccaggtatacggcattgctcgaactgaggccaaggccaaaacattggctctcgcagaggtcacgcccatcatctgcgctgatccagtaaatgaacctaaatcctatatgaaggctgtccgcgactaccacatcgatgttattgtcgacattgctggcgccaatcaagagtcggccaagttcctcagccatgccaaggagatcagccaagagcgactgaacagctatgccgcttctggcattaagggccctaagcttggattcatctattgttcgggcacttgggttcatggatctagtgataaagcagtcaacgatctcaacatcgctgggcccagcggtgtcacccctccaagagctcttgtagcgtggagagttggcctcgagaattccatcttggcatcttccgatgtcttggacgttgctgtcctaagaccagcattgatctatggctacgaaaacaccattttggacctcttttatccttccactccttcaagcagctcgaagtggctcctcggaacctgtcaacgttcctctgcaagctgacgccaggccggcgctcattcacgttgacgatgtggctactggtttccaaaaggcgattgagaatctgtccctgatcaacagcggctctgtatacccggtatttgatctgctcactagtcaagagtcaatgactgagatcttcaacgccatggcctctgcttggggttacaagggagaatgcaagctggttgggtctggcgataatttgtttgccgaagctatgagcacaactttgcgcggatcttcatcgcgtgccaaacaattgcttggatgggagccaacacgaaccaatgggtttgttgccgacatggatttgtatgcggctgcttttgcctctcagcattgatgatatatgtggatatagtggggtgtggatgtactaaagagcgttgagaatatcatgattactgtttggttgcgttgaatagctttggaattagatctgatgagatttgagataatatatagattgaacaagagaaatgacccaaaaaaaaaaaaaa

SEQ ID NO: 7517 - DNA, 1192 bp, Trichoderma harzianum
cccacgcgtccgcccacgcgtccgcccacgcgtccgcccacgcgtccgcgctttctaggcccttgtttcatttgagttcaaacgcttcttctcgtctctcgttcagaatttatttcgcgtccttcaaacaactcaaaatgaagtactctgtcgctgccgtctcggcctttgccgccgtcgttctcgccaagcccgagttcctcaactctgctttccaggtccaggagggcaagccttttaccctcgagtactctggctgctcttctggctgcgagattgttctccagactggtgctagcaccaacctgaaggacgtcaaggttcttgcttcttctgccaccggctcctccactaccgtcaccctggaggacattccctctggcatctacagcttcaagatcaccgacaagagcggcgagagcaactacagccagcagttctcctaccagggcagcggcaaggccatctccagcgcctcatctgccaccagcgctgctgagtccaacacggctgctcccacctccgagaccaccacggctgagcccaccagcaccaaggcttcctccaccaaggagcactccaccacgctggtcaagtcaaccactgctcactccaccaccgaggaggcctcgagcaccaccgcccactcttccattccccccaagcacaactccaccacgattgctcccacacacgcggctacaaccaccactggaaggcaaaccactgctgcttctacttcctcaaaccccgccattaccaccgttcctcccggaagcgccgctggccgcctctcttctcccctcgccctcgttgccggcgttgccctcgccattgccttcttctcttaaatttgtggataggaggcatgggggggagcgggagtcccctccttattttttgcgcattaaggattttttctctggtacacggttaaatttaatatcttgaggcaagattacgttgttgtgttgcttttttcttcatacagcagggccaggttgttgggaaatggatggaagaaggggagggtgacgtattcccggcgtctgtcaactcttttcctattttattgacgattgcatggaatacctacctactcttcttttgacgataatgtcagcccctgcatgtactctagtggtatactaatgcattatatcccccgtttttttctttaaaaaaaaaaaaa

SEQ ID NO: 7518 - DNA, 1251 bp, Poppy
gtcgacgaattcatgtgaggttgtttcagggtagcggccagtatgacggttgcttatatttataccctaacctcgaggacgttgaaacgttcaccttcattgactggaaaaaggtcggtctgttgcccgactatatccggatcaagggcgacaacggaaatcacctcaaggctggcggtgacgggtatatgggctgccatcacaaagccgataattacccaccagtgtttgatttcgaggtgtccccgagtcgcgacggaggcgtccgcctcaagagtgcttactatgacaagtattggacggatatggatgatagtgaatgggtattgttaaaggaggcttccaccacaacccatgaaaccaacaccgtatttatacccacgggaaatgttggcggcgcaatccaaatccgaagtctgaagagcggtaagttttgcaagatattgacaagtcatggtaaagagttgtgcctcgccacacagagatcctatatagatgattgggccaatatgaagattgaagagccagttaactcaagggtgatgaccgactacaaatatgattttgaagatgcaagggcatacgatgacagagtaactgcactcgtcactggtgatgtgaaaaacaaaggtagagaaacttccatgaccgatgtgataaaactcgggcactcagtgaccaatacaactaattggaacgtcagtcacgcagtgaaagtgggtttcgaggtaactgctagtcctaaaatcccagttgtaggtagcactggtttcactttttccacagattatactttcactaaggaaaacggaggagtcaaggaagaaacacaggaaatcgcgagggaggaaacagtgattgtgccgcctatgactaggaaggtggggactctggtggaaagacgatgttcatacgacataccttacacgtacactcagactgactccttaaaaactgggagaacaaaaggttacgtaaagcacggcatttgtaaactcgactacggatacaaatatgatatagaggttgtcgaccttcctttcgagtaaagatcgcttcgtccctggcatcgtcttgcacagcatgatcctttaatttgtttgcagtatgtttgtttctcgttgttccttgtttgtggtgtgttcgtatttatgtttatgtttgatgttgtccagtccatgtctgttttctttatttatttgtaatttcgtacaatcatgaataaaataatttcaaaaataaaaaaaaaaa

SEQ ID NO: 7519 - DNA, 1148 bp, Trichoderma harzianum
gatacccagtatacagcagaccgtcccgaatatcccaagtatatcaagtgcaagactgggtttataacaatcgtttttgataaactgcaatttttctcatttcatacgcgtattggaagacactttattcgtatatttacgatctgttcctttgcctgtcgagtacaccactacaccactcaacgacacctacatatttcctttcaccatggcaccaaccgctatcgttgatctcggcgagaccttttccgtcggccagaagctggaaaatgtctccgacgccatcgacgacgtaaactgcatcaagtacgattccgagtccaagttcgacgccaacaaagacaaggcaaacttccgccagtacgaggatgcctgcgacagggtcaagaacttttacaaggagcagcacgaaaagcagactgtcgcctacaaccttgctgctcgcaacaggttcaagagcgcttcacgggtgcgcccggagatgaccgtctgggaggccatagagaagctcaacactctcgttgatgaatctgacccagacacgtcgctgtctcagatcgagcacttgctccagtctgctgaggcgattcgccgcgatggcaagccacgatggatgcaggtaacaggtctgatccatgaccttggcaagctcatgctcttcttcgacgagctcgaaacacagggtcaatgggatgtcgttggcgatactttccccgttggctgtgcctttgacaagcgaatcatcctgcctgatacctttgtcaacaaccccgacacgaaggatcccgtttactcaaccaagtatggcatctattcacccggctgtggcctggacaacgtgatgctcagctggggccacgacgagtatctctaccatgtcgtgcgcgatcagtcgcttctgccggatgaggcgcttgccatgatccgctaccactcattctacccctggcaccgcgagggagcctacagggagtttatggttgagaaagactgggagatgatgaaggcagttcaggcctttaacccgtacgacttgtacagcaagagtgacgatgtacccagcgtggaggagctcaagccctactatatggagctgattgacgagtttttccctcaaaaggtcgtcaaatggtaaaaaaaaaaaaaaa

SEQ ID NO: 7520 - DNA, 1338 bp, Trichoderma harzianum
gattgattgctcaaacatcacaacatcagtcaatctctccaaatggctcggtcagccgccacaacggccaccaaagaggccaagcctcaggctactgctgctgctgctgctcctccagctccagctccaaccgacggcgataataagctgcacgacttcttctggacttacaccgaagagccgcaccgcacacgccgtctggccatcatcaaggcccatcccgaggtcctcaagctatgcggccctgagcctctgaccaaatatgtcgttgccggcgtcgtcgggctccagatcgtcctggcctacctcctgcggtcaacgcccttctggtcctggaagttctgggccgtcgcctacgtctttggcgccactgccaaccagaacctgttcctggccatccacgaaatctcgcataacctcgccttcaggagcccgcttgccaaccggctcatcgccatcattgctaacctgcccattggcatcccttatagtgcttcattcaggccgtatcacctcactcaccacaagtccctcggcgtggatggcctcgacaccgatctccccactgccctagaagccttcgtcctcgactccatcttcggcaaggccttcttctgcacgttccaaatcttcttctacgccatccgccccatggccgtctaccgcatccccatgacctggatccacctccctcaacgtcgtcacccaattcgcctttgacgtcctcctcttccgcttcgcttctatcaacgccctcctctacctgctgctctcctccttcctcgccggcagcctgcaccccctggccggccacttcatcgccgagcactacgtctacgagaccgtcacccctacgcagcggaacccggacaacaaggtccccgtcccagagaccttttcctactacggccctctcaacatcctgacatacaatgtcgggctgcacaacgaacaccacgacttcccggccattccctggaccagactccacgccgtgtatgacattgccaaggagttttacgagcctcttccccgccacgagagctgggtgtatgccatttggcgtttcatctttgacgaaacgtgggtattagctgccgtgtcaagagaaaggagggcggccgtatcgttggcggcgccgtcaaatggaagcagtcggaaatcgaggcttaaaaaaaaagaatacaccatcaaaggggggtgggtttcatgtcgttttgtgggtagagtacgcaacacacagccattgttcaggttaggagggctagaatcttgtaataagcgtttctttgcgatatatatatatatataaaagcacctcactctaaaaaaaaaaaa

SEQ ID NO: 7521 - DNA, 768 bp, Trichoderma harzianum
gatgcccggaagacaagacgcttattccgtttccatgcccacaaactctcctcctcccccacagagcatctccagctactctcgcttcatccacgaccacacaaaacgccaaatgcaggcctttggagctgctctatcgcctacaagttccggtgcttcgggtcgatcatcagtcggtacatccatgaccaacggcacagcacctgccatgtaaccatcttgcatttccgcgggtgtccaaaagcgaaaactcgctgcttgaatttgcgcatgtttagctttagcggtgcttctcttttttccagtagcttgccattatggcagctacattggtaatctggacgggacttggaaaaaaatgaatttcgggacagtctaatatggaataacgcccccggtgtaacatggcgaatccaagattggaacgcctgcatagagacaaagcagcttctttttaccgatcacgcatttacactacagcaaaagcaactcttgcgtcacatcgaaaacgagccgacttggtgccactcgctaatttgtcgcttcgtttctatttattattgattttatgactatatgatacacgcacggcgtttttgggggggatctttatggcaggatactaatcggttggggattcggattccctttggcgcagtacatacgtgggaacattggacagttggaaggacgagggggctatatccaggctggaaagccaccgtacatgataatgataatagcaatcgacgataaaaaaaaaaaaaa

SEQ ID NO: 7522 - DNA, 852 bp, Trichoderma harzianum
cccacgcgtccgggaatacaagactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacgtcggcaaggccaagggcacatcttggaggatgaacttcttccgaaccgtcgtcagccctgagatttaccctaatcagactcttggtggatggtcgccgccagaccaggcgagcttccatattacaaagttctttggtcatgtcaagtttatttgatcgggaggatttgggtttacgattgatgtttgcgagccgtaaagcggaattacaaagcacatgtacataatgcggcatgcctgatctaatgtaattgtcaatgatgaatgatcttaaaaaaaaaaaaaaaaa

SEQ ID NO: 7523 - DNA, 1286 bp, Trichoderma harzianum
ctgatgagcaaatcatctcatcaagctggcttttatcagttgttgatgctgaattaggtggttttcatttaaataattccaattctttcaacattcacttgacgaaatggcaaaccttgctactgggattcacaaattccaagggccggacattgaactaacttatacggtgcgaggatccggaccatatcttattattcaggcagcaggatggggaatttcttctcagtatcttcaaattgggctttcgcctcttgaggctcaatttaccctaatatacatggagccccgcggctcaggcccctccgagcgaccacaagaagacataatgagcacttccgatatgactgacgacctcgagcttttacgaaaacacttggaatttgaacaaattaatttgcttggtcattctaattgaggcaccatcgccttagcgtatgctgagcggtaccccgcctcagtccgaaacttgatcctcctcacacattggcccgaaggatacgatgacagtcgcacttggcaacgatttctagatgagagaaagggcaatccagcattttcaaaagcccttgcggtgcttgagatagccgaaactcaaaaattccggtcgcaagaccagtggtttcaaaacttacgcgtgaggttgtctttctatccggccaacccagacaaagattattaccccgccttcgagaaggcaataggtgagcctttcatggtgggtttacaaagctcagggtgcagccgacaagatcaagacccttgatctctatgccgggctcgataaagtcaaggcccgtacgctatgtttggggtgttctgaggatccaatatgcactgagaatgtcactcgtattacagcagagcacatagccggctcgcagctcatcattattcccgagtgtaagcattttccttggattgaacagccagatcaattcttcgaggcggtcattgagtttctgaggtgaacattagaagtcagtgctaccacaacgtcttcatgagaatacatcgcgtccacagaaaccgtcgcaagttcaggcagcttcggttttggaggaatctgaggccgtggaggacatgaaaggaccagaattagcttattcacaaggtacaagcagctgcagagtcccacatcaatcgacatagcgtcctagagcacacaaatggccgccagacgcggggttgcaagatgttagagaatagactttattttctaagcttaagatacaccctggttgacaaagatatcctcttaaagtaaatgccaaaaaaaaaaaaaa

SEQ ID NO: 7524 - DNA, 1249 bp, Trichoderma harzianum
  misc_feature (776)..(776): The residue at this position can be any nucleotide.
gacctggatgctcgagctcggagatgtgcgaaacgcctcgctcttctaccgtgaccccaagtccctccccgaccgcaagcccggcctgccccatcccgaggccgataccaccaagcagtatgccgcactccatactcccccggtcgagaagctcattgccaactatggtgatgcttccaacacctcttggctcgacgagcgattcgagatttggcgacacaagtctggcgccgccattggatatgtcaagcaggagaagtttgccatgatcactggcgatcctctctgcgataagtcgcagtacaaggacgtcatctcgtcgtttgtcaagtacgttgtgaccgagctgcggctcgtccccatgtggatgcttgtctcgtacgacgtgcagaggattctagcacacgacttgggctggcgaaccctctcctgtaccgaggagcagcgtgtcgataccgcgagacaccagagcccggctggcggacccaaggcccgcagagtcgagcgtgaaggcgtcaagattcacgaagtcaagcccgacgaggactttatctcgcgcgccaacccggccattgaggcctggaaggccaaccgcaagggcaagcaggtgcacttgactgaggtgcgcccctgggtcgacccggagcaccgccgctactttgccgccgagaaggacgacaaggtgcacgccatggttgtcttggccaagctgtcgcctcgccacggctggcaggtcaagtgggctctggacttccccggagccgtcaacggcgccntcgaggtcctcattgagcacgccctgtcgtgcgtcaccggacaggtgacgtttggtgtcggtgtgtcggagaagctgactcctggcgagcaccttcacggcatccgggccaagttccttgccaccacctaccgttcgattgtcgagagtcttggcctgcgcagaaaggctggtttccgatccaagtttggtgccctcggtgaagaggtgtacatttgctaccccaagcacggcgtcggcttgagagatttgcagcaagtcatcaagtttttccaggattaagggatgctcgcatgaaataaatgataccaaatgataccaccgaaagctcacaatgataaactcaactcggaaaaaaaaaaaacaaagaagcatacctaaaaacaaagaagcatacctaaaaacaaagttaccatgtctttttgagacccttggagtttgaatgatggctggctgctttgcatggcatacggg

SEQ ID NO: 7525 - DNA, 635 bp, Trichoderma harzianum
ccatgtacctctgggatccttcacaaggcacaaagccggttgcacggcttctgggacaccaaaaggccattaaccacgtgacattttcccctgatggcagtctcatcgcgagtgccggatgggacaatcataccaaaatctggagcgcaagggatggcaaattcatcaacacactccgtggccatgtcgcgcccatataccagtgtgccttttctgccgatagtcggctccttgtgacggcatccaaagataccacattgaaagtgtggtcgatggctacgtgtaagctggccgttgatctaccgggacaccaagatgaagtttttgccgtatgtttgcccccttgcccttccaattttgttaacccccgagcctgtggctgacagcgtgctaggttgattggagtcctgatggacaacgagtaggcagcggaggaaaagacaaggccgtacgcctttggatgaactgatgacgatgatgggagcgaatcaaaaaaggataaatcatgtgtgttatcggcgtccagtcagggattgattacgtgtatgttctaggtctagactctgtagagctgtttgtgcagcatccgctaatgatagagagcaaatgtggcatttgcccaagggcacgggctg

SEQ ID NO: 7526 - DNA, 222 bp, Trichoderma harzianum
  misc_feature (49)..(49): The residue at this position can be any nucleotide.
atagtagatctgctatatgtaaatgcaatcaagaccccgtaacttcaancccatgcgaatatgatgcagtgtatcccaccacctcaaagtcwaaccccagttcgtcaacaatcgcttcaaastcaacctcctcttctccgagctccttcttctcttccttgggtgtttcsgctgacagaaacggttccgcattcccttccacaggcctttctaccaastctg

SEQ ID NO: 7527 - DNA, 1021 bp, Trichoderma harzianum
ctcttgttcatcttgctaccgctcacaaatcaccagccaagcggagacttaacaagggcttatgtacatgtaggattgggccgtgtccgggaattacctgttaggtactaaggcatgtaagagatgatgcaatcacaaagcaaaacccttttgatggtatcaaagtaaggcatcaacatcaattaatgtctccgaaactacatgcaatccgtagctccaagcccctctcattcttcaacttatcatcatctttactccttttatacaaaccggagcccacaagccttgccgattctaactaaactaaaccctcactccccgcttccaaactaccggcgactttacaaccaacaaatcttcaccatgagtgcctcacagcaacacgacgaggagtccaaagccctcgcctcaatcatcccaaccttcactccttccgaatcttccgaatccactgccgtcaaatcaatcatcagctccctctccctcatcgagcacgtcgaaggaggctatttcgcagtcacagacgtcagcaacatcaagatcccttccccgtacccagccacgcccctctcacagcgcaccatcgacctcgtcaatggcctccccgaagatttcgactacgcgctccgccgcctttcgactacgatcttttactatctgacgcctaaccggcctcaaggctcattccacaggaaccgaagccgcatcattcatagtctccaccgaggccgtggccgctatgttcttatccatccagatggccgtatcgaatctttcgttgttggtcccaacattgagcgcggcgagaagctacagtgggtggtggagggtggcgtgttcaaggcaagcttccttctccctgacactgatggtcagtctggcagtgatggtctgctcatttcggaaacggttgtgcctggtttcgagtacgctgatcacgagtttctgtctcacgaacgggtggtggaagttcttccagaggccaaggccaaggcgctggagtggcttgtcaagcactgat

SEQ ID NO: 7528 - DNA, 1438 bp, Trichoderma harzianum
  misc_feature (1401)..(1401): The residue at this position can be any nucleotide.
gtcctttacccaccaagtgatcttatcatgatcaattaagtgccggtcgaaaatacgaatatccggaatcgctcaagacttgataaccgcagcattcatggggcgattgtgctcaagccacacacaatgagtccaaacaccagcgggagcaagaatggcgagaggaaacgatccgccccctcagatgatgctgctcctcagcaaacctttttcaagcgtcagagaacagcactagcttgtaatagttgccgctcccgaaaaacacggtgtgacggctcgcgtccccgatgcacgatgtgtgttgagatgggcctagagtgcttctatcagcagccagcaggggcgccggggaaacaatactctacagagctcgagggaaggctacactctatcgaagagactctgcgtctactggtggggagacaagaagcagctgcccccccttcattaaacgccagaagtgtactggattcagaagatgctgaagagtcaattagagatgactctcaagctcaaatccagtttgaggacacagtggacggcatggggggccattacctttgcagatgagcaggaatctggtttcttcggaccttcttccaatattgctttcattggacagatcacacacgccatggctaccgccgcaaacgcggaccccacacgagctctcccagttgatgcaaggatggagggcgcaatgatgagcatctctcgaccagcatcaccaatcgccggagcacaaagtctagaccatagtctttcggcggcagtggatgtttacactcttccacccgaagcagacatgttacatcttatccgactgttctttgccgacacagggatgctatttccatacgtgcacgagggctctctgctggaagagtttgtcgcagcaaaacaaaataatttcacatcaattagacgctcatggttatgtctagtaaacatgatcctagcgtttgccacttgtgtcagcgcccgacccgatttgcctgtcgaacgaaatgcggcagagtcagatgtcttcttcaagcgcgcccaagctttgtctgggaaaatggcattcagaaccgcaaatgttgagattgttcaatacctattgttgatgacgcaattccttcaaggaacccagcgctctgctcaaacatggaacctacatgggcttacagtaaaagcggcactccagctgggactccatacctctagttcgtacaccaagttttcaccgcttgagagggagataaggaaacgcacttggtatggctgtgtagttcttgataggacgctgagcatgacatttggccgtcccccagcgataccggttgagtacgttcagatggcacttcctttagatatagaatttgatggaatcaatgccatcactggcccacacatggnaaatgctgggcagcccatcaccagtatcattttatat

SEQ ID NO: 7529 - DNA, 1307 bp, Trichoderma harzianum
gcgcctcaagcacagtcccgttgcctgacacccaaaagtccattcctctctctgttcgccttgccgctccacgactctccgtccgtccgtctgtgctctgcggatccaaccaagcaccggcccaagcaccggcatcagcgcgagattcagctccagctccatccagccccagccagctcgctctagcctagcctcacttgcctggctgccagcatgtcctcggcgtctcagcggcggcgacgagatgaagacgactatattccatttggacccccatcactccccagcacacagacgcacctcgacaacatgtcgtcggaacttggctggccaccgccggtgaccatgtccgactcgagcgacgaggaatttcgagaccaccggacgaatgcgcgacgcatttcgcgccgaaaccacatgccgcatggcattgacggactgatgaacaatggccgatactcgcccgacgtgtattcagtcacctccgatcctccaagccagacgcccatgctcgacgccggcatgcaatctcaatacgccggcatacactcgcaatactacgccacgagaacgcccaacccagggccacagatcaagccgcacctgtcatccctagatataccaagacgctacggcagcaatgccatcctcgacatgtatgcgctcacctacgtcaccgaccctgacccgaatctactatgtcccatctgccatgaccccctcgtcgaccctgtgacgactccgtgcgaccataccttttgctatcgatgcctacgcagaagcatggcgtcgagccccgcgggcggtgcctgtcccatcgacagagaggctctgctgtggacagactgttccagctccatacgactgattcgaacacagctcaacaacctgattgttaaatgccctcatcacgggagaggctgtgaggaggaaatgaggagagaggtggtggagcgacacgcaaccatggagtgcagtttccgagaatacccttgtcctgatgccgaatgctccaagacaatccgctataaggcgacagatgacaagtgccagcatcaagagaacagctgcacgttctgcgacgccatcatcgaggacgctgatcttgatattcatctgctgcagtgtccaaagagcaagacgcggtgcgcgggctgctggatgttaattcttcgcgagcaagaggacagccataaaaacctggactgcgatgccattgaagtggggtgccgctttcaagctgctggctgcccagtgagggttatacggcaacaccaagagcttcatgccctttcctgccctttcca

SEQ ID NO: 7530 - DNA, 1433 bp, Trichoderma harzianum
cccacgcgtccgaaagggggtgatattggaatacctagggacgcctctcaaaccggcctgttccatgaaggaaaccctgcagcagcgccgttagactgacctgacttgacgaaagcaccggtcgagacaggatgaatttgcgcagccgggcatcgcagccgcacccgcagcgcatcgcatcgcatcgcatcgcatcgcagcgcatccaagacaaggccggtccgggtccggcccagccagctgctttttttcatcatcttctttttgtttcggcgcccctcatgatatcagtccagtgacgctagagcaggtgtcacatggccgatgacaacaacgtggtggtgcagctaagctccggctagctgttatctggcgacggaatgtgtgtgatgccattgggtggtgttgcgaatggctgctggttcgcgcgggctcacactcacaccatccatcaccaacagcccaatgacctgttcaacgtcccttgccccatacggtactgtacatacatgtactcgtgcagtccagtccagacaatctcgctgacggaggggcgcgccacaagtggaatcaatggagtgatccaatgtgaaggcatttctgtcttcttggacaggcagggggtagcagtacctgcacgcactgcagcgcattttagcgccgctccgtacttgtacatgagaagggggtccagcgcgccacttttgtgcagccaagtgccatctcggtacttgattgcgagaggctacttttggttggttccctgccagcccagcgtcgtgcgaaatgtgctccatccccatcccatacgcaatgttgccgcatcgcaagcaaccctcatcgcctgtcctggtgcgttttcagcaggtagtactccgtagttgcactgtactgtagcggtcgtcaatcatttcaccctcaatctcatgctcgtgctcatgctcaatctcactcactcactctcacgtggtaatttgcgtgtacttacacggtacggtagggaggagccgcgggaggaggagcatcgtgatgttcccctcgctgcgtcgaaagaggcaaacagggccagagtgaatcgagatggcccttcgtcccacactgctccatccagtccagtcaagtccagcattcttatgggtggccacgactgactgacacggcatacggtgctgcgctcgtacttgtacctgttttgctctgctgctgctggtttgcgagcatgtgctccgtatggctggatcgccctccaattaatgctgcgctggagtttcaccgccactcatcagggcggcttcttgttacaggagaatcaggaggtcgaatcacggccccctttgattgatgggcgctcaaacaagaccttttcgttcttctgccccccctggccacccccctgccctgcttctgctttggctgctttcttctgcgacgtc

SEQ ID NO: 7531 - DNA, 1500 bp, Trichoderma harzianum
cgcagaaactcgctgcggaatcaaccactgcaatatgtcttatcaaggatatggccagccctacggccaaccaccgcctccccagggctatggccagtatccccctcctcaacagggccaatatcctcctcaacagcagggccagtaccctcctcctcatgggcaatatcctccggcccagcaagggcaatacggccagcatcctccccctcagcagggaggttattaccagtctcccccgccccctccaggccagtatcccccaccacaagcgccctacggacagccgccgcctcagcaatacggggctcctcctcctcaacaccaacagccttacggagctcccccagtgcagcctacgccgccgtctattggctatggcgcaccccagatcattcaatgggacggcaccccagatgcccaggctttgcgcggcgccatgaagggctttggaacggacgagaagacactgattaatgttctctcgcgaaaagacccgctacagatcgaggtgattcgatccacttacgagcgcaccttcaagcgcaggctggtggaggatataaagagcgagacaaggagttggttcgaatttggtctggtgcagcttgctcgtggtccactgctggctgacatccataacctgttcgatgccatggcgggcccgggaactaaggaggttgtcatgaatgacattctactgtcaagatccaacgccgacctgagagctatcaagagcgcgtatcagcaaacattccgacgaagcttggagaacgatgtcaagggtgaactgagcttcaagacggagaggcacttcttgatagtgctggctgctaatcgagctgaggactcagcgccagtaaatccacagcaggtggaggaggacgtcatgaacatctacagggcgaccgagggcaaggctggcaccgacgagattctggtgtgcagcattctcagcaacagaaacgacaaccagatccgagccgtcgcccatacctacaagcaaaagttcaaccgcgacttggataccgtaattcagagcgaattctccggccatatgcgagaggctctcctattccagcttcgtcatgctgttgataaatatatgcacgctgcacagcttttggaagattccatggctggcttgggcaccaaagaccatctcctcatttctcggactatccgattccactgggatcggaacgagcttgcaaacgtcaagggagcctatcagcatcgttacaagaagccattggccactcgtatcaggggagagacgtctggtgattaccagaagctgatggttgcctgtgttggagagtaaatcatataaattcttgggccggcagctgcattggtggaatcccaacacggttacaccctaatggaaacttacacctagattctttaatgatggctggagatcatgaggcgtttggaaacccttttttttacattgtattaacaaaattttggcgaggtactaccaggacatcaagt

SEQ ID NO: 7532 - DNA, 958 bp, Trichoderma harzianum
gttcgtgctgaagatttgcaatgcgcgcgcacatctgagtatcctgagacggctgcagtctactgcaacttgtactctacttggggtaccagatgctcccttcggagcaggatcacgattcaaacgcgcatcaatcacaggaaatccctgtcgtctgtgttttgttccaacccggaactgctcaaattgggaacccgaatgacatactgtttaccgccatgtgtgtggttggttctcttgagaatccgagacatattgtctgtgacaatcgcattgtcgacaaatcaacaaatcaaaaatgcgccgttgcgctgtttgccaaagttggtgggtgggatgctcttttattcattttgctcgcctttttttcttcttgcgctctagcacgccaacctggattccaaccttctgggaccacccgatcgatcgtggcagaattgaacgcacgaatagggcttttgtgtaacgctggaaaggaccacggtggccgctggtatccattctgtccgcacacttacttcggcattggggccaacgttcctggcgatgcagcgggactggtggcatgagtgggtagttgacatgttggctgcccgttccgaacttctccatcggccccatttccactgcgttgccagatccgttgggatcaagatttaggacgctggtggcctaccaacgcccgcatccgaggagaaccacagcggacgtcctccgtacttttctccccgtccgttgacgatatgctaccagcacatgcgccctgaacatgcaccatgttggactccatagtaagattgggctgatataccacgcgcgtgcgaccgagtagagcttcgtgcttcccatgcaacgggcggacgccggcggctgtttattttaggcatggaattgccaacgcgtttgccagtaccactcatgtgcgcctctcaccatggttcgaggccttgcgcataga

SEQ ID NO: 7533 - DNA, 1383 bp, Trichoderma harzianum
attccaaacgcgcatcacgaccagcgattcttacttcctcgaacggaccaaacgaatactctggacgagcttaaaatccctcaaactcattcttttatacgccatagatcccctaattctacggacgttgcgtccagtccgcagagcccatcatgccttctgcgaccggtcaaaactgggagaaatacaccaagaaattcgccgacgatgagatagaggagaagaagatcacacctctcaccgatgaggatattcaagtgctcaagacatacggtgctgccccatatgcatcgaccatctcaaagctcgagaagcaaatcaaagagaaacaacagagcgtagatgagaagattggcatcaaggtatgagtcggcgcaactgcgatgcgtctacggctatctaacgtgttgacgtaggagtccgatactggtctcgcaccgccgcatttatgggatgtggccgccgaccgacagcgaatgtctgaagagcagcctttccaggtggcacgttgcacgaagattattgcggacgataagggcgacgagtcgaagagcaagtatgtcatcaacgtcaagcagattgccaagtttgtcgtccagcttggcgaccgagtcagccctacggatattgaggagggcatgcgagtaggtgtcgaccgcaacaagtaccagatcatgctgccgctgccacccaagatcgatgccagtgttaccatgatgacggtcgaggagaagccagacgttacgtacggtgatgttggtggctgcaaagagcaggttgagaagctgcgagaggttgtcgagatgcccctgctctccccagagagattttcaaacctcggtatcgacccccccaagggcgcattgctctacggccctcccggaaccggaaagacgctttgtgccagagctgttgcaaacagaacagatgccacctttatccgagtcattggtagcgagcttgttcaaaagtacgtcggcgagggtgccagaatggtccgagagctgttcgagatggcccggacaaagaaggcatgcatcatcttctttgacgaaatcgatgctgtcggcggtgctcgattcgacgatggtgccggtggtgacaacgaagtccagcgaaccatgttggagctcattactcagctggatggcttcaacgcccgaggaaacatcaaagtcatgttcgccaccaacagaccgtccacattagatcccgctctgatgcgacctggacgtatcgaccgcaagattgagttctcgctgcccgacctcgagggccgtgccaacattctccgaatccatgccaagagcatgtcagttgagcgagacatccgatgggagctcatctcccgtctctgccccaacgctaccggtgccgagctga

SEQ ID NO: 7534 - DNA, 1423 bp, Trichoderma harzianum
cgcgatgatccccgcagcagcaaaaacggccgaaatccatcccggctgccactaagaatctccctttggggcagccgctagtgtcgggagctgttcttcccgaacacttctgcgacgtgccttgccctgtttcagacaagctgatgatgatgatgggcttgcacgaccacgcgcccgtctgtgctacacgcccggatctgccttttcgcaggtttgcttgcgggggctgaggacagaggccagaggacaggatgcggtgagtaggctactctggaggacggggttgaatgaaacgttgatttggtttgttgttcgcgcctcacgccctctctattatcgcgctttcaacatctgcatctgtctttgtgatatattcgtttacagctcgcggacacgaatttttctccattatcagtcaactaagactcactgctctggtgcacttctctcctagggctttcaacgaatgctccagcgtaatactggactgctggtgcctcctattcgttgccgcctacagtctacagtctgcacacttgagacaagagagacagagagagaaatgccagcaccgctactctagacaatatcccttgctctccctacaggagagatatctccctcccttgcatgcccttttcagcaaacaactcttatcacccgaagctgaggagaatactttcttactgcggcgcatgacgaagcctcgctggccttcaaatactctgccggctggcagctattttttgcccttactatcaccatctcaacttaacgaaatttctatgctatagcacacaatcgccatgtaccgtcaatccaactcgacgccgttcccgtcggcggtcgaggcaacgtttctctttacatcctggacgccccggaccagctactatgcagctgtcctcgctttgctactggccgcatggcttttgaagccaaagtctcagtgcaacaagctcagtgtgcccttctatggagcttcgaaattgaagtggattttcgatgccgagtcacagattgttgccagctacagcaagtttcgagaccaggtttatcaaatcaaggcgacagagggaatccaagccatgatccctccaaagtttgtcgccgagctcaagggattgcccgaggatattcttagtgctacggaagccgtagccgacgctcttcaaacaaaatacaccaaattctcgccgggtcataatggggacatgctctcacttctcgtcagaaccagattaactcagaatcttgtcgagttgatccctcagcttaaggtcgaactggagcactatatcggtaccgaattcccttcttgcgaagactggacacctgtaaaatggcagccgttcgctttgcgtggaattgccccgactcagtggccgagccttcgtcggaccctttctgaaccgagacgagc

SEQ ID NO: 7535 - DNA, 1383 bp, Trichoderma harzianum; identical to SEQ ID NO: 7481

SEQ ID NO: 7536 - DNA, 1276 bp, Trichoderma harzianum
  misc_feature (473)..(473): The residue at this position can be any nucleotide.
ttttttttttcttggatttaacgtagatttatttcattctgcttaaaaaagcaattcccatgctgtccagcccatctgctcgtggctatattatgtacagtacatgcatgttctgtgagacaaccacccttcatttcatcaaggcatcatcaatttttcccaccattccgtcatattccgcacacaaacaatcctaaaccgctcaacccaatttcatcttctactgcagcgtgggcatgtgcaccgcggcctttttggccacggcatcggcgctctgccataacgccgtcaccgtcttgagctgcgtgtaaaagttgataccaggtcggccgtagaaggtgttggcaccgcctccggcaatcgacttcttgttgccggtgaaggagaacatgggcagcggcacggggatgggcacgttgatgcccacctggccggcctcgatgttcttgcggaacgtctcggcggtggcgccncgactttgtgaagatggcaacgccgttgcccgtactcgttcttgttgatgagctcaatggcgtcgtcgatggtctcgacgttgaggcacaccagcacggggccgaagatctcctgcttgtagcaggtcatgtcgggagtgacgttggagatgatggtgggtccgatgaagttgccgttggggtacttttcagacttgaagccacggccgtcgagcaggatcgtagcaccctccttctcggcgctgtcaatgatgctcaagatgcgctccttgctctggggggagatgacggggcccagatcggcaccctcctcgaagccaccatcgaccttgagcgcctgcgcatgctcagcaacctcagagagccactccttggtctcgccaaccatgaccagtgtgctcagggccatgcagcgctgaccggcagctccaaaggcagctcccacgacactgttgatgaagtggttcttgttgcagtcggggaggacggcggcgtggttcttggctcccaggttggcctggacacgcttgccgttggcagaggcccgagtgtagatgtactcgccagccttgttgccaccgacgaagctcacggccttgatggcgggctcgtcaaggatgaagttgacggtgtcgtgggcgccgtggatgacgctgacaacgccgggagggaagccagccttttcagccagttcgacgaggatcatggcggcaccgggatcacgttctgagggcttaatgacgacggtgtttccggtgatggtggcaatggggatagaccagaggggaatcatggcagggaag

SEQ ID NO: 7537 - DNA, 802 bp, Trichoderma harzianum
  misc_feature (669)..(669): The residue at this position can be any nucleotide.
  misc_feature (788)..(788): The residue at this position can be any nucleotide.
cccacgcgtccgggcagtagtacacagtctttgtcttgtctttgtcttgtttcttcgttgatataccgccgcctatcatgcgccgtctcctctccgtcagcgcctctgccagtgcccgcggattgactgccgcttcccctcggtctaccattgcccttgccaagatggcctccaaggctcaggctgccacagccgtcaggaggattcatgccacggctcagcagctcaagccaatggacgccctgtcgtccacggccaccagcttccccacgacgcacgagcagatcgagaatgtgcagaacacgccctacttcatcaacaacaagtttgtccagtcgacgacggacaagttcatcgacctgcccgacccggccaccaacaacctggtgacccgcgtgccgcagatgacgcaggccgagatgaaggccgtcatcgagagctccgagaaggccttccagtcgtggaagaacaccaccgtgctgttccgccagcagatcatgttccgctacgtgcagctgatcaaggacaactgggacagactggccgccagtatcacgctcgagcagggcaagacctttgctgatgcccaagggcgatggtgctccgtggactgcaggtcgccgaggctgccgttggcgcccccgagctgctcaaggrcgaggttcttgnaggtgtccaaggacatgccagacgaggacctaccgtgtagcctctggsrcgtcactgmcgacmatctgcccctttaaytwccctgccatgtatytcactctgcatctatccgcatttgncamgcatcaccgat

SEQ ID NO: 7538 - DNA, 761 bp, Trichoderma harzianum
gtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctggtatgtcgcaagctgcttgttgctgataatgtttttatttcatctggattcacatccaaccccttttgtccttgctgtccttatcctcccaaacccttcccgtcgcagccgtgacaagactctggcgcaatcctttacgattgcgacgtcggagccggcgaacccacaaatatcccatcgcttgactaatagctaccgtgtctaatgaactctatgactgatgatattcttacttacagggaatcggcgcctaccgagataacaatgcgaagccatgggttcttcctgtggtaaagaaggtacggtgtcttcttttttgctggcgtcccatttggagagctcggcgccgcgaatgcgacgcatgcaagctagcttgtgatgccaataataagctcaattggcgcaccaattattggtccagcccacttgctgctagacatattcatacatcacaacatcgctgacccactgctttatacaacagggctgatgagattctccgaaacaaccccgaactgaaccacgagtatgccccgattgcagggtatcgagagcttcaccagca

SEQ ID NO: 7539 - DNA, 696 bp, Trichoderma harzianum
  misc_feature (639)..(639): The residue at this position can be any nucleotide.
  misc_feature (651)..(651): The residue at this position can be any nucleotide.
  misc_feature (654)..(654): The residue at this position can be any nucleotide.
ggcttctcacgggtagttgtatgaagaggagatatcttgcaggtttttttatctacctgttttcaccccttggacgtattatttcttattagttttgtttgtttgccaagaaattctattcgccatggctgtaagacgaatggtgtttgccgcggctcttgctggtctggcgatggccaagcccatcaagcccatcaagccaacaggcacattctgtggcatcatctgcataagcgcgattagcgattgcggcgtaccatatggaggttgctacgatccttgtgttgacccagcccctacacctcttccttgtgacgtggaaggtccagttccggagagtccagtcgttgtgagcccagtcccagcaacgccaaccagcgaaaatccgttctcagtcacgcctggttcgacctcagtcactcccaccgtggagagtccgagttcagtcactccagcctcacagaccccagtcgttgtggtgagcccagtcccagcgacgacaaccggtgagaacccgagttcagtcactccagcctcggacactccagaagatgaggaaactcgagaagattctgaagatccagaagacgaggaaactccagaagattctgaagatccagaagacgaggaaactccagnacttagagtcgnccnatagcaaagggatccagttccagctggggccgaccggcaaaa

SEQ ID NO: 7540 - DNA, 1373 bp, Trichoderma harzianum
  misc_feature (1294)..(1294): The residue at this position can be any nucleotide.
  misc_feature (1308)..(1308): The residue at this position can be any nucleotide.
taccgcattgcattccatttgattgcttcattttcagtccatttgttggtcttttctgaaatacccatataccggtgtacacccgtatatatacagctggttgaactgcactccgctcgcattcaatcttccccactacatcatcacatttcttctttctcccacaaacaacatcacacacaaccgtcatcatggccaaccgagaaattctgtcgtctcgaaccgagactctcaacaagtacctgaagctcgaccagaagggcaagatcatggccgagtatgtctggatcgattctaccggcgagactcgatcaaaatccaggacgctccctgagctcaaggacaaggaatacacccccgaggatctgcccgtctggaactttgacggctcttcaactggccaggctcctggtcacgattccgatgtctacctgcgccctgccgccgtctaccccgatcctttccgtggctctcccaacatcatcgtcctcgccgagtgctggaacgccgacggcactcccaacaagtacaactaccgccatgagtgcgccaaggtcatggaggccaacgctgctctcgagcccctggttcggtctcgagcaggagtacactttcctcgaccacgatgacaggccctatggctggccccgttggcggtttccctgctcctcagggtccctactactgcggtgtaggtagcggcaaggtcgtcctccgtgacgtcgtcgaggcccactacaaggcctgtctgtatgctggcatcaacatctccggtaccaacgccgaggttctctcaagtcagtgggagttccaggtcggcccttgcgtcggcatcaacatgggtgacgagctctggatcgcccgtttcttccttgcccgcatcgccgaggactttggcgtcaagatctccctgcaccccaagcccatcaagggtgcttggaacggcagcggtctgcactccaacttctccaccaaccagatgcgtgaggagggtggcatgaagtacatcgaggaggccctcaaggccctcgagccccaccacgccgagtgtatcarggagtacggtgaggacaacgatctccgtctcaccggtgactgcgagactggctccatcgagaagttcagctggggtgttgccaaccgtggcacatccatccgtgttcctcgcgagactgctgcccgtggctgcggttacttccaaggatcgccgccctgcctccaacgctgacccttaccgtgtcaccccagatcctgatgacttcaatttttcggggaaggcctaagtcttctttgnggatggcttgtggngagttgagaggatgatgtggtaccgaaggaaaaattctacattatgggggatgtaacattaacgg

SEQ ID NO: 7541 - DNA, 1373 bp, Trichoderma harzianum
cccacgcgtccgcccacgcgtccgcccacgcgtccgaacgaatcgtccactcagctcggctcaatcatcatcacaatggctctcaacctcaccacgtcggctcgagccctgcgctccttcaagccctacacccgtgctgctctccttgccaacgccgcgcgatgctactctaccgctgagcccgatctcaagacaaccctcaaggaggtcattcccgccaagcgcgagctgctcaagaaggtcaaggcccatggcagcaaggtcattggcgaggtcaaggtcgagaacaccctcggcggcatgcgtggcctcaaggccatggtctgggagggatccgtcctcgatgccaacgagggcattcgcttccacggccgcaccatcaaggactgccaaaaggagctccccaagggcaagacgggaactgagatgctccccgagtccatgttctggctgcttctcaccggccaggtcccctccgtcaaccaggtccgcgagttctcccgtgagctcgcctccaaggcccagatccccgccttcgtcaacaagatggctcgacgagttccccaaggatctgcaccccaatgaacccagttttgccattgccgtctcggccctcaactacgagtccaagttcgccaaggcctacgagcagggtctcaacaaggctgactactgggagcccacctttgacgattgcatttctctgctcgccaagctgcccaccattgccgccaagatctaccagaacgcctacaggggcggcggtgctctccctgctgaggttgaccttgagcaggattggtcttacaactttgccgccatgctcggcaagggcggcaaggagaacgaggacttccaggacctcctccgactttaccttgctctccacggtgaccacgagggtggcaatgtgtctgctcacgccactcacctggtcggcagtgctctcagtgaccccttcctttcttacagtgctggtctccagggtctggccggtcctcttcacggtcttgccgcccaggaggttcttcgctggattctccagatgaaggaggctatccccgccaactacaccgagcaggatgtccacgactacctctggtctactctcaactccggccgtgtcgtgcctggttacggccacgccgttctgcgtaagcctgatcctcgattcgaggctctcatggactacgccgcttcacgccccaccattgccaaggaccccgtcttccagctggttgagaagaacagccgcatcgctcccgaggtcctcaagaagcacggcaagaccaagaacccctaccccaacgtcgacggcagctccggtgtcctgttccaccactacggcttccacgagaccctgtactacaccg

SEQ ID NO: 7542 - DNA, 1550 bp, Trichoderma harzianum
atcaccactacatcttcccaagatactttgcttcccccgccagctctgggaagctatccatccatcgacaccatggataatatcggcggcaccatcaagcgccgttcgacggaggtatggcaagctgcgcagaacaacatgcccaccatgccctctatgcctgccatgccttctttgcccgctctcccttctctgccggccatgccacaattctcgtttgattctttccggaggcaaccccagcaggaaggcctgaaaggcacctgggagcgcattgacttgcccccggttcctcgttcctcccactctcttgacatcatctctggctgcgcctacatctttggtggcgagatcaccccccacgaacccgttgacaatgacattgttgtcattcgccttccctttagcagcgctcccgccgactacttcaagatcccggccaaaccagaccatacgatccctgtgccggcaccgattcaggataagggcaaaaaagatggattggataagccttccaaaagggccaaggccaaagctgaagaccttggtgaagaactcgaagaggaagagagtgacagcgacaacaatgatcccactgaagagagtgaccaaggagaatccacgccgacaacagcggataagggcaagggacgggctgacaagttgggcgatgtcccgtcaccacgagttgggcatgcaacagccgtcattgggtcccgcatcttcttgtacggcggccgtggtgggccggatatgaggcctttggatgaagggggccgtgtctggatctttgacacccgcactcgactttggacctatcttgaccccgtcccggctgtcaagggcggatccatcgtgcctcatccagctccgcgaagctatcacagtgctaccgcgacggatcggccccgcgactttgcccctcccccgccaacccagcctcagacctggcaggagtgggcgcttggtgatacctccaagacgggcatcccccaggatcccattgttggcaacgttgccgagaatgcaattgacgaggagacgagcggctacggcaccttcttcgtgcatgccggtgttctggccaacggcgaccgcactagtgacctttgggcttttgacgtccattcacgcatgtggactgagctgcctgcagcgccaggacctgcccgtagcggcacttccatctgcatcagcaagagtcgaatcttccgttttggtggatacgacggacagaatgagattggaggccagctcgactttttgaacctcgaggtcgaaatgtttgatgaccgtgtcactcggggtgaggtggctgttcgagcccgtggtagctggcagtctatcctggaggccatgcccgaggcttcctcgcatgagattccgtccgagaatgtccaggtctggcccgcaccgcgaagtgtgtcttctcttgaagccatcacctttggcggcggcaccgagtatctcgtcctgaccatgggtgaagccagcccgagcgcagacggctacaacggcgccggcaatctcacaacgaacgtggggggtat

SEQ ID NO: 7543 - DNA, 1329 bp, Trichoderma harzianum
cccacgcgtccggtaggttgtcgatagcctcaaatatctagagagcagcgatagccacaagacactcgacaagactcgattcgagagctcgcgacaagcgcaccatagaaaatgccagctcggcggaacaggcgcttcttctcgcgagagccattccacaatgacgaccggctaacattgcagcacgccgaggggccttttggctttctcaatccaacaagagctcatttcgaccactcagcactggctccgaagccgacgcctgacgagatagcggaaccacatgagagcggcgatgatgcggaaaccaagcaccaacagacaaaacaagccgccgattcgaacgtccccgccaagaacgtcaagttcctatggcggtctcgagacaatcgaaagggtcggcatcccttgctcgttcaaaagccgctcccgggagaggaagcgcctttcgtgacaccaaggtgcacgtcgcatccccgggagattttgaagacggtgattaagactttcacgtactaccccatctgggaacattttcggtggctggtggccttcatattcacatggggaagcattagtctgggttctaaatagtttcttcgtctggcttccgctcgtggctccctctaccgagttcgacggcgaagtctactgggccggtggcataaccgccttcatcggcgccatcgtctttttcgaattcggttccatccttctcatattcgaagccataaacgccaacaggtcgggctgtttcggttgggccgtcgagcaattggtcgacaatgggagaagcggcaagccgaggcttggggtggtcgcaagccgccatcattgccaccaccatcaccaaaatcgacgcaactttgtgggcaagccctcagctaccacttcgattgaagctcagccggatcctagcggggctaaggatgagaggcaatggcaatggttcccttcgtggcacgacctgcgcacacattacattcacgagttgggatttctcgccggttgtgcacagctcttcggcgcgactgtctttggtgtgtctgggtttactgcgctgccggggattaacaatcatctcacgccccaatggcgactcaacgctgcgtactggatccctcaggtcgttggaggcagtggcttcattgtcagcagcacgttgtacatgctagaaacacagcagaaatggtggaagcccgcacctcaccttttgggttggcacattgcatttttggaatctcgtgggagcgtttgggttcacgctctgcggtgccctgggaatggcatataacaattctggggcgcaatttgaagctggactggcta

SEQ ID NO: 7544 - DNA, 1437 bp, Trichoderma harzianum
ctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcgcccagtatccctacttcagcaaggagacccgggggctggactttgatggcatgaccgctgccatctcagcggctcctgaaggttccatcatcctgctccacccctgtgcgcacaacccaaccggcgtcgacccaacacttgatcagtggaaggagttggccgtcattatccgagagaagaagcacttcccttctttgactgtgcctaccagggctttgcctctggcgaccttgctcgagacgccgccgctgtgcgttactttgtcgagcaaggcttcgagctcgtagttgcccagagcttcgccaagaactttggtctttatggagagcgagctggctgcttccacgttgtggctgctcctgccgctgatgccaccaccacaatcacccgcattgcatctcagcttgccattctgcaacgatcagagatttccaaccctcctttgtatggcgccagaatcgctagcaccgttctgaatgacgcccagctcttcgccgagtgggaggagaatctgaagaccatgtccggccgcatcatcgacatgcgcaaagctctccgttccaagcttgaagagttggagactccaggaacctggaaccacatcacagaccagatcggcatgttcagctttactggcctatcagaaccccaagttctcaagctccgcgaggagtatcacatctacatgaccaagaacggccgaatcagcatggccgggttaaataccaacaacattgaccatgtggctcaggccatccgaaaagtcgttggtgagactcagtaatttgtatgataatggtttgatagatgggcttcgaggacgtgacgatattatcaccgccgctggccaggaacttgcgttgtttcgattagtgttcttttttcctttgtattcgatagcacatg

SEQ ID NO: 7545 - DNA, 1415 bp, Nicotiana benthamiana
ttttttttttttggagagatttatattcatttataccatacactgctactatctgattgtttgatactggtacaaccatttgacattgagtacttttcgcagacctgtgcataatagttgtaaacccctatacttcacacagctcaaacaaggtttttacaatacgtgctttgtcccagttacattataccggcacagaccaagtaaccagcaactttgttcctcgaaactataagggagcaacagttgttcctgaaagtttgggaccattaccgctcttccagtcacctgaagccagatggagcagcctgagcgtagcaactagaagaggagtgctccacaagacaatgatattaccagctattgagtacaagaacatggacaaccatccgtactcggactcgcggaaagattcaattctcttgttaaaatgttcttcccatgcctggaactttataacacgcatataattaagcatctcatttgttgccttcattctggaatcacgattcttcatgatgttaaattgaaacctgttgtttcttttagttccaaacaccacaaataccatcactgctgcaagtccagctagtgttacaacagttgaagcaccgaggtaagtataaaaggatggctaaagccacagaaacttgcaatggcatgagccaaatggaatgtagctgtagcatcatatcggacagctgctgagcatctacggccatataatttacaatctgtccaacaccatgagcctgtctagctgagcatgacaaccttaagcccttcttatacaaagaagtgacaagtgtcgatcgaataagcattccaagcttttgggagttaaaattgaactgatgagaggttaggacttccacaaatttggctattaggagagttcctataaggtagtatccttcataaggagatgtcctaattccagctgtgtaatcaacaaatctttgtatgagtgttggccctacatacataacacagaccctaattactgcaagaatggcagtaaaaacaacttccttccaaaagcaacgcagcaatgttgttctcacaggatgcttcgagttttcttcaggtttaggccaattcctttcgaaaagttgagacattttctctgctctatgcagtggggaaagtgaaggaacttcatcaatcttgagaggtgacttgtaacctttttgcagtaaagggttcatccaatccaaaaggctttcgatattagagaagctgaagcaaagccactcacactggatttatccagaagaggttcataaccattggttgcatcacttaagtgagattcagaatcactaattacagcaactccggtcgaacctttaatggaacaatgaagagaacacagaaataggaaaggaaactaatgaacttatatcatccattct

SEQ ID NO: 7546 - DNA, 602 bp, Nicotiana benthamiana
tccgaaataggctgctttgaataccagcagaagaagaactggctgcttctagtgttagtgaamcagcaaggaaactgcaaaatagatttcttgagctgagatatgtgaatttttctcaagaaattctatctctttggctttctgtagtgggtatataaagacataaaggttgaatcttttatggtttaacatggatataaggaacaatctctccacagaatcttggttagcatcagtttcttgttctgcctccacactacaatcttcagcagtggttaaatggttaagattcatcttcctctctccatgtccacaaaggactcttctatcttccattgatgtgctgcttttgcttactttcattgtgtttgccgtacaaaagttttactcaaagttgaggtccaatgagcactctaattctggcattgataagcctcttattgcacacaacaggacttctgttaaaaccaatctatggtttaagctgtctctgattttgtcagctatwttagccttatcttctatagttttatgcattttggttattgtggggaaatccccagtcgtcttggaaagtcatcgatgggctgtattggttgttt

SEQ ID NO: 7547 - DNA, 1053 bp, Nicotiana benthamiana
  misc_feature (511)..(511): The residue at this position can be any nucleotide.
ttttttttttttggacaaagacggtacaatgcactaacaaaggtttaatattacagttgatcgcgaagacgcaggaaaaaagaatgtgtaaaacatgaatggacaacaataaaagaatgtttaatgaataaaacattaaccagtgtgatgattctgcaacaagatttgtggatccgttgtttgaatatctgtcaattttaagcagagatgagctttcactggcttatgatcagagctgcggatgctttcaattgcttcatatgaatgtaaagttgcattgattttgttactgtctatcttgaacaatactctgtctgtccacgatggtactctaaccaaccaattaatgtcaaatcaagagaaggaaatatttcttatatcctaatttatatgacacacttttctttattcaatttagtcatatatcactatacatttgaagctactagcccgactaagtcggtcaaagtaaggcccactaactattacatcacatcccttactctttggngattaatatgagattctttttacttttagacgtttaaaatgtctgacgacacttctcgcttatgtattattttaaacaatttttgtaagttcaaaatctcctagcttttttttaattcttttaactttttcatattaaaccaatcacccaggctttcatctcctgtggtgttggggtttggctcggacccctagctacctcgtcgattatattaacaaaagagtacaacctttaattaatcatgtatagyattttaatttgacgttttttctctatttaatcaactttttcaactagtagtttaacctttttttcacaactacgcaagttaaattaacattttaaacgyggcgcctcaaatgattaaataaaaggagcaataagattagactaattaattaccttgtgacaggtatcatagctgctgcttccaatatcatatttgtaagttggtttgaaagctaatgcaccctcgcaabacccattaaaaatctctcctctttctgcttcttgtaatagttgatccytgctagttagaatct

SEQ ID NO: 7548 - DNA, 569 bp, Nicotiana benthamiana
  misc_feature (55)..(55): The residue at this position can be any nucleotide.
  misc_feature (57)..(57): The residue at this position can be any nucleotide.
  misc_feature (251)..(251): The residue at this position can be any nucleotide.
gtaatcacaaacaacagagagtgatgtytacctatcccctactattgccccccananacttttccatgaacttattagcttagcagctggctgtagacttagccccccaattgtcttctcaaacgtagggctcatttcctgtacaagtttgatcgattctgatagtcgattaaggaggtttaccagagcaatcacttcatttctttgcaactgcagatgtttatcatggcgatattcaccatcaacagagntttttttctttagtgcagttccaagaccaagaacctggagctttccccacagtcggcatttctcacatcctacacaatccatgatagcgctgatattcctgaattgcttttgaatctgctgctttagctcaggtccactttggcctttccacagtttagcttcgtcaaaaggaactggacatgcagcctgcagtttggggctgtatagtagctgtcgcataagggactgtgctttaagatcttcctcaggattaccagtatcatactcagcctgctccaagtaatcttttgcttttgttacagctcggagaacaaaga

SEQ ID NO: 7549 - DNA, 1064 bp, Nicotiana benthamiana
tttttttttttcctacgaatcagggttgtttttgtcaattatccgaaagaaaaacagattattattgaataagacagtgtcgggaggaacagttgtccatatcaaaatgagaaagagatgaacaacaatgaagaaatgaacatcaagattccaaagacttgcttctcaacgctcccatctttggtagctggaaaagctggctgcttcttgcctgagttgctgcacattttagctgttcagcagccaaccattttcacgtcaatccagatatttgaatctgctcaagtgattctgagaccgggaaaagtgttgctgccctgcttcacttgcatggaaagcctttgatgctccacacgctgaagctgcgatgacaactggagcaaatcgatagtgggtccatcttcacaagaaagttgatccttgtggttcacaaaatttggaccttgaatgatcccattgacgccacaagtgttgctaggaaatagtatctggtccagtccaccttctgcagaattgaccccagagaatgaatggttggacattcctacctgctgaatcctgaggactaagtcccggacttctttagatgcttgagtcagactgtaacgtgaattattgcttggggatatcaggggatgagcggcacgaaaaacagtggaatgatttgacgagtcccgtgattgagatgacagaagagagagagcattgctggagtttgatatccccgatagcccatgaatagtacaagatgtgtccaagacatgcaagacttcagatccagttgaggtggtgtggaacaatgaaggggaaacaaaatctgatcctcgcatatcttgcagagatgagatgatattctcattaattctgctcgttgttacagcaggttgtccttcatcatggagaggttgacattgtttcttggcatgatataacgtaaaaacagattttggttgcaactgttcatttgaaaagggtatggcaagttgggggctacgttcaacaccatcttcaacttttacattcttataccagtcattcatctcaaattttggctgatgcagaaa

SEQ ID NO: 7550 - DNA, 692 bp, Nicotiana benthamiana
  misc_feature (71)..(71): The residue at this position can be any nucleotide.
ttccttcggcgctcattatgaccagcaaggacgtttcctgcaggcttcgtttgccatcatcaaattcaggntagcagatggaacctggctacattgctgacaaaccctttgctcgatgccgtttacgatacccttagctgtctttgagtgaacctcacaaactttatgcctcttgtgataatccttacaagagctgagatccttcccacaaccttgaacctgacaaaatggataggaattcacacctcctgctctcattctcttggctggaacaatggactcagcacaagagacattaggcataatcttgggagatttgtaaacatttgcatctatttgatcaggaaatcttccaagcttcaaatcaatcagtgatgaatctttagagtttgattccacaactgagcttgataacttggaactagacttagatttattttccccagaatatgctgcactaggactagctgccactgaaccaaaaatactttggtcactgtacatagtttttctcatcaaattttgagaacccaattcaggaaatccttggttactagtactaccttgttgacttgagcacataacatagctgctaggggttttcaattcccaaaccataaatccatttttagttcgccccattccatcatttacagaaactgattcctctgatatgaaaccctttccccctg

SEQ ID NO: 7551 - DNA, 605 bp, Nicotiana benthamiana
caaaaacaaccagccccattttcttcttcactctgcttctccttactttcactccaaccccatctttctccattgaaaatgatatcaaatgtcttgaaggaatcaaatctgcactttctgaccctttcaataagctctcatcttggtctttttcaaacacatctgttgctgcttcaatttgcaaacttgttggtgtttcttgttggaatgagaaagaaaaccggctcatttctcttcagctcccttctatgtctctctccggttctctacctccttctcttcagtattgtacctctcttcaatcccttgatctctctggtaactccctttccggttcactcccggttcaactctgttcttggttgccttatcttgttaatcttgatttatctggtaactctttctctggttccatacctcctgagtttatttactgcaaattcttgaatacccttttgctaaatgacaataaacttactggttcgatcccttttgagattggccggcttgaccggttgaaacggttcagtgtgtcaaacaatggtcttacaggtccgggtcctgatgatttagaccggttcttgaaagatgattttgaagggaat

SEQ ID NO: 7552 - DNA, 692 bp, Nicotiana benthamiana
  misc_feature (664)..(664): The residue at this position can be any nucleotide.
gttgaaagtagatattttctcggacttcgaagacatcttcaggtaacaatttggagaaaggagaatggcgttagtttcaggaggaaggtcgacactgaatccgaatgcacctcttttcatcccgtcttatgtgcgtcaagtggaggatttttcacccgaatggtggaatttggtgacaacttcgacatggttccatgattattggacgagccagcatcaaggagaggaatatggcgatgatgcttttggttttgctgggaatgatgttgctgacttgcttcctgaaaatatcgatcttgatgttgatgaagatattttgaacatggaagctcagtttgaagaattcctccaatcatctgaaagtgaacaacaaggaatcaagtcatcgctctatggtgtcaatggtttacccaagggttcggaggcactcgtacggacactgagcatgccaaaggggccaaaatctcccattgagccaccaaagtactatgagaaaccagcaaagattgttagcccaaagaacagccttcgccgcatccagcagcctcgctaaatgtagtttagcttaagcaaaagctcttggtttgtagtttgggaatgtcagtccttaatttgcagcttttagtcttcttcacaaagcatcagttgagagtctgaggagtgnttagtttctggtagccttttgtatagag

SEQ ID NO: 7553 - DNA, 1856 bp, Poppy
gtcgacgaattcaggagagagaaactaaaaccccccccaaaaaaaaacaagaaaaaaaaaaatggccgtctcagcaggatgtgctagggttctaccggtttttgaatgtagatcagatccagatttctctacaaaccagaaccagcagaaatcaagttccagattcatttctggatctttcaatggtggtggtgggttatattcatcattgattctgcggtttcctcctaatttcgtgaggcaattgagtattaaagcaagaaggaattgtagcaatattggtgtagcacaagttgttgctgcttcctggtcaaacaatgacaataccaacaagaaggttcctaatgtatctgctgtcgattctgcttctgctgcttctgagattgaagaaattcctttgattgatgatgaagttgtggatgctggggttgatggtggtgatatttgtaataataatggtgtacagttgtctggtttggccgctttaaaggcctcatttttacgctccgatgggagcatcacagttcatgcaggagaatgattaggtcgtggaattgctacagatggaatcactaccccagtcgtcaatacttctgcttattggttcaagaactccaatgaactcattgatttcaaggagggacgccataaaagttttgagtatgggcgctatgggaacccaaccacagtagttgcagaaaacaaaataagtgcacttgagggggcagaatcaactattttgatgtcatctggcatgtgtgctagtacggtcatgatgtttgcattggtaaagaagggtgggcatataataacaactacagattgctacaggaagacgagaattttcattgatgattttcttgttcccaacatgaatataacggtccatgtcattgaccctgccgatatggatggcctgaaatctgcattggagaataataatgtaacacttttctttacagaatcacccacgaacccttacctccggtgcgttgacattgatttggtttcaaagctttgccacagcaagggcacaccggtttgtgttgatggtacttttgctacaccattgaaccaaaaggcacttgcacttggtgcagatcttgttctgcactcggcaactaagtttattggaggacacaatgatgttcttgctggttgcattagtggttctgaggaagtgattgctaagattcgcaagttgcatcatgttttgggtggtactcttaacccgaatgccgcttacctaatcattcgaggcatgaagacactgcatcttcgtgtacagcagcaaaacacaacaggacagaggatagccgaagttttagaggcacatcctaaggtgaaacgtgttcattatcccggtctgcccagtcacccggaacacaaaattgccatgaagcaaatgacagggtttggaggagtcgtcagttttgagattgatggagatttagaaaccaccaagacattcatcgatgcactgaaaatcccatacatcgctccttcctttggaggatgtgagagcattgtggatcagcctgcaattatgtcttactgggatcttagcaagtctggtagagaaatgtttggaataaaggataacctcgttaggtttagtttcggagttgaagactttgaagacctgaaagatgatatccttcaggctttggaagttatatagataggaggcaaatgctgagggccatgaatatcatgttctctaatcgagtgtcctaaatcatcggattattttgattgagcattgcttttatttatgcatgtgttggttatttgattgaattagtaatgacagttatgacggattttgataatgaagatgagggttggtaacttct

SEQ ID NO: 7554 - DNA, 1827 bp, Nicotiana benthamiana
ggcgacggcgaaaaggataaggatagagataaagatagagatagggaaagggaaagatcttcgaggcatcggagcagggagcgagaatcggagagagacagagagagaagctcaaaggaccgagaccgagaacgtgacagagagaagagggagaaggagaaagagagggagaaggagaaggaacgagagagggagaggaagagtagagatcgggatagggagagagataaggaacgggagaaggagaaggatagagagagggagaggtcaaggaggagccggagtcgctccaggattgaacgagagcgagagcgagagaaggagctgtcaagagaagtcgagcgtgaacgtgactttgaatcacgagacagcaggagattcaaggagaagaaagaaaaaattgaaccagaagctgatccagaacgggaccagagaactgtttttgcttaccagatgcccctgaaggcaactgaaagggatgtgtatgagttcttctcacaagcaggaaaggtgagggatgtgcggttaatcatggaccggaattcaaagcgatcgaaaggagttgggtacattgagttttatgatgctatgtctgtgccaatggctattgctttatctggtcgcttgctttttggccaaccagtcatggtaaaaccttctgaagctgaaaaaaaccttgttcagtcaactgcgtctggtggtggatcagggttggcagggccaaatgctgcctcagagagaaaactttatgtaggaaatcttcatttcaacatgacagagttacagcttagacagatttttgaagcttttgggcctgtagagcttgtacaattacctacagatcctgaaacagggcattgcaagggttttggatttgtccaatttgctcagctagaacatgcaaaggcagctcaaagcttgaatggcaagcttgaaattgcgggtcgcaccatcaaggtttcatctgttactgaacatgttggagtacaagatgctggagctaaaactgcagattttgatgatgatgaaggaggtggcttggccttaaatgctcagtcaagggccatgcttatggcgaagttggaccgaagcggtgttgcttcaagtgttgcgggtacacttggagttcctgcacttaatggagcagctccagctcagatgagcatgcccataggtggggcaacagcttttccgaatatgctcccaacgcaagtcattgctgccatggctcctgaacccattggaattcccagcgagtgtttgctattaaaaaatatgtttgatcctgcaaccgagacggatcccgaatttgatttggatattaaagatgatgtgaaggaggagtgttccaagtatggcagggtcaagcacatccatgtggacaagaatagctctggttatgtatacttgcggtttgatagcgtcgaaggtgcatctcgtgctcaacaagctatgcacaagagatggtttgctggcagatcgatttcagccatcttcttgcaaccttatgaatatgatgcaaagttcaaaggtacaggctgaaaggtttcagacgggggggatatgtatgacgtctgaagactgctgatttgttgatgagtaattgcaaaaactgcagcctgtttttgtatttaagttcagatcttagtgataccaaaaactcctaaaaggtactgtataagccgacatatgaggttatacatgttattgagggaaggttgtgtaattttaatattctcatttttagtcaaccatgatacttggggccccatcttgttttcaattaatggagctcaactaattgtgtgcaaaaaaaaaaaaaaaaaa

SEQ ID NO: 7555 - DNA, 51 bp, Artificial
  Synthetic
gaggatgttaattaagcggccgctgcagttttttttttttttttttttttt

SEQ ID NO: 7556 - DNA, 24 bp, Artificial
  Synthetic
gatcttaattaagtcgacgaattc

SEQ ID NO: 7557 - DNA, 20 bp, Artificial
  Synthetic
gaattcgtcgacttaattaa

SEQ ID NO: 7558 - DNA, 40 bp, Artificial
  Synthetic
gccttaattaactgcagcatgtcgggtcgtgaagatgaag

SEQ ID NO: 7559 - DNA, 48 bp, Artificial
  Synthetic
ttgatatctagagcggccgcttatcatgtttcatcatcgaaatcatca

SEQ ID NO: 7560 - DNA, 59 bp, Artificial
  Synthetic
gactagttctagatcgcgagcggccgccctttttttttttttttttttttttttttttt
